US008148088B2

(12) United States Patent
Wu et al.

(10) Patent No.: US 8,148,088 B2
(45) Date of Patent: Apr. 3, 2012

(54) REGULATION OF AUTOPHAGY PATHWAY PHOSPHORYLATION AND USES THEREOF

(75) Inventors: Chun Wu, San Diego, CA (US); John A. Mountzouris, San Diego, CA (US); Bingren Hu, Palmetto Bay, FL (US); Chunli Liu, Palmetto Bay, FL (US)

(73) Assignee: ABGENT, San Diego, CA (US)

( * ) Notice: Subject to any disclaimer, the term of this patent is extended or adjusted under 35 U.S.C. 154(b) by 0 days.

(21) Appl. No.: 12/505,281

(22) Filed: Jul. 17, 2009

(65) Prior Publication Data

US 2010/0086541 A1 Apr. 8, 2010

Related U.S. Application Data

(60) Provisional application No. 61/082,179, filed on Jul. 18, 2008, provisional application No. 61/082,174, filed on Jul. 18, 2008.

(51) Int. Cl.
*G01N 33/566* (2006.01)

(52) U.S. Cl. .......................... 435/7.1; 436/501

(58) Field of Classification Search ........................ None
See application file for complete search history.

(56) References Cited

U.S. PATENT DOCUMENTS

| | | | |
|---|---|---|---|
| 4,816,397 A | 3/1989 | Boss et al. |
| 4,816,567 A | 3/1989 | Cabilly et al. |
| 4,946,778 A | 8/1990 | Ladner et al. |
| 5,004,692 A | 4/1991 | Tso et al. |
| 5,225,539 A | 7/1993 | Winter |
| 5,260,203 A | 11/1993 | Ladner et al. |
| 5,530,101 A | 6/1996 | Queen et al. |
| 5,565,332 A | 10/1996 | Hoogenboom et al. |
| 5,585,089 A | 12/1996 | Queen et al. |
| 5,693,761 A | 12/1997 | Queen et al. |
| 5,693,762 A | 12/1997 | Queen et al. |
| 5,789,208 A | 8/1998 | Sharon |
| 5,969,108 A | 10/1999 | McCafferty et al. |
| 6,103,889 A | 8/2000 | Whitlow et al. |
| 6,180,370 B1 | 1/2001 | Queen et al. |
| 6,331,415 B1 | 12/2001 | Cabilly et al. |
| 6,335,163 B1 | 1/2002 | Sharon |
| 6,355,245 B1 | 3/2002 | Evans et al. |
| 6,407,213 B1 | 6/2002 | Carter et al. |
| 6,432,914 B1 * | 8/2002 | Levine ........................ 514/19.4 |
| 6,548,640 B1 | 4/2003 | Winter |
| 6,867,007 B2 | 3/2005 | Kauvar |
| 6,884,869 B2 | 4/2005 | Senter et al. |
| 2005/0238646 A1 | 10/2005 | Ledbetter et al. |

FOREIGN PATENT DOCUMENTS

| | | |
|---|---|---|
| EP | 0 120 694 | 10/1984 |
| EP | 0 239 400 | 9/1987 |
| EP | 0 404 097 | 12/1990 |
| WO | WO-86/01533 | 3/1986 |
| WO | WO-91/17271 | 11/1991 |
| WO | WO-92/01047 | 1/1992 |
| WO | WO-93/11161 | 6/1993 |
| WO | WO-95/20401 | 8/1995 |
| WO | WO-2004/009618 | 1/2004 |

OTHER PUBLICATIONS

Maiuri et al. Functional and physical interaction between Bcl-XL and a BH3-like domain in Beclin-1, May 16, 2007, The EMBO Journal 26(10):2527-2539.*
Adermann et al., Innovations and Perspectives in Solid Phase Synthesis, Epton, ed., (1994) Mayflower Worldwide, pp. 429-432.
Amaravadi and Thompson, Clin. Cancer Res. (2007) 13(24):7271-9.
Baehrecke, Nat. Rev. Mol. Cell. Biol. (2005) 6(6):505-510.
Bialik and Kimchi, Adv. Exp. Med. Biol. (2008) 615:177-200.
Bird et al., Science (1988) 242:423-426.
Byers et al., Seminars Cell Biol. (1991) 2:59-70.
Chu, Am. J. Pathol. (2008) 172(2):284-7.
Chu, Am. J. Pathol. (2008) 172(4):1153.
Czernik, Methods in Enzymology (1991) 201:264-283.
De Wildt et al., J. Immunol. Methods (1997) 207:61-67.
Fanger et al., Immunol. Today (1991) 12:51-54.
Galluzzi et al., Curr. Mol. Med. (2008) 8(2):78-91.
Greenberg, Dev. Cell (2005) 8(6):799-801.
Harlow and Lane, eds., Antibodies: A Laboratory Manual, Chapter 5, pp. 75-76, Cold Spring Harbor Laboratory (1988).
He et al., J. Biol. Chem. (2003) 278(31):29278-29287.
Holliger et al., PNAS USA (1993) 90:6444-6448.
Kundu and Thompson, Annu. Rev. Pathol. (2008) 3:427-455.
Lateef et al., J. Biomol. Tech. (2007) 8:173-176.
Lee and Iwasaki, Curr. Opin. Immunol. (2008) 20(1):23-9.
Lefranc et al., Oncologist (2007) 12(12):1395-403.
Lerena et al., Curr. Mol. Med. (2008) 8(2):92-101.
Levine and Kroemer, Cell (2008) 132:27-42.
Liberski et al., Folia Neuropathol. (2008) 46(1):1-25.
Lorin et al., Bull. Cancer (2008) 95(1):43-50.
Lum et al., Nat. Rev. Mol. Cell. Biol. (2005) 6(6):439-48.
Mann et al., J. Neurosci. Res. (1996) 43(5):535-544.
Martinet et al., Trends Mol. Med. (2007) 13(11):482-91.
McCray and Taylor, Neurosignals (2008) 16:75-84.
Merrifield, J. Am. Chem. Soc. (1962) 85:21-49.
Mizushima et al., Nature (2008) 451:1069-1075.
Mizushima, Genes Dev. (2007) 21(22):2861-73.
Neuberger et al., Nature (1984) 312:604.
Newman et al., BioTechnology (1992) 10:1455-1460.
Nixon, J. Cell. Sci. (2007) 120(Pt 23):4081-91.
Nixon, Trends in Neurosciences (2006) 29(9):528-535.
Obara and Ohsumi, Seikagaku (2008) 80(3):215-223.
Pluckthun, in The Pharmacology of Monoclonal Antibodies, vol. 113, Rosenburg and Moore, eds., Springer-Verlag: New York, (1994) pp. 269-315.

(Continued)

*Primary Examiner* — John Ulm
(74) *Attorney, Agent, or Firm* — Morrison & Foerster LLP

(57) ABSTRACT

The invention relates to polypeptides and proteins known to function in the autophagy pathway that have novel phosphorylation sites. The invention also relates to antibodies specific to these polypeptides and proteins that are phosphorylated or not phosphorylated at novel phosphorylated sites. The invention also relates to methods of producing these antibodies and use of these antibodies in the treatment of diseases related to autophagocytosis.

6 Claims, 13 Drawing Sheets

OTHER PUBLICATIONS

Rajawat and Bossis, Hormones (Athens) (2008) 7(1):46-61.
Schofield et al., Genome Biology (2007) 8(11):R254.
Shacka et al., Front. Biosci. (2008) 13:718-36.
Shintani and Klionsky, Science (2004) 306(5698):990-5.
Tanida et al., Int. J. Biochem. Cell Biol. (2004) 36:2503-2518.
Tanida et al., J. Biol. Chem. (2004) 279(35):36268-36276.
Teunissen et al., RNA (1998) 4:1124-1133.
Thorburn, Apoptosis (2008) 13(1):1-9.

* cited by examiner

Nonphosphorylated Peptide

Phosphorylated Peptide

APG4A-S100 Polyclonal Antibody

Nonphosphorylated Peptide

Phosphorylated Peptide

APG4D-S15 Polyclonal Antibody

Nonphosphorylated Peptide

Phosphorylated Peptide

APG4D-S341 Polyclonal Antibody

REGULATION OF AUTOPHAGY PATHWAY PHOSPHORYLATION AND USES THEREOF

CROSS-REFERENCE TO RELATED APPLICATIONS

This application claims priority under 35 U.S.C. §119(e) to U.S. Provisional Application Ser. No. 61/082,174 filed Jul. 18, 2008 and U.S. Provisional Application Ser. No. 61/082,179 filed Jul. 18, 2008, the entire contents of which are herein incorporated by reference.

REFERENCE TO SEQUENCE LISTING SUBMITTED VIA EFS-WEB

The entire content of the following electronic submission of the sequence listing via the USPTO EFS-WEB server, as authorized and set forth in MPEP §1730 II.B.2(a)(C), is incorporated herein by reference in its entirety for all purposes. The sequence listing is identified on the electronically filed text file as follows:

| File Name | Date of Creation | Size (bytes) |
|---|---|---|
| 549132000400Seqlist.txt | Oct. 26, 2009 | 1,031,966 bytes |

TECHNICAL FIELD

The claimed compositions, methods, and kits are directed to antibodies to detect autophagy proteins in either the phosphorylated or nonphosphorylated forms.

BACKGROUND ART

Autophagy is a process whereby cells convert proteins and organelles into amino acids as a source of food. Many cells in the human body rely on autophagy to maintain homeostasis, especially when insulin levels are low. Autophagocytosis may play a role in human disease and aging. In eukayrotic cells autophagy occur constitutively at low levels in all cells to perform housekeeping functions such as destruction of dysfunctional organelles. Dramatic upregulation occurs (e.g., cytoplasmic and organelle turnover) in the presence of external stressors (starvation, hormonal imbalance, oxidation, extreme temperature, and infection), and internal needs (generation of source materials for architectural remodeling, removal of protein aggregates). Autophagy is highly regulated through the coordinated action of various kinases, phosphatases, and guanosine triphosphatases (GTPases).

At least three different autophagy mechanisms are known, all of which result in targeting of cytosolic proteins and organelles to the lysosome in order to provide amino acids and energy in the form of catabolites. These types are macroautophagy, microautophagy, and chaperone-mediated autophagy.

Macroautophagy is a major inducible pathway for the general turnover of cytoplasmic constituents in eukaryotic cells and also plays a significant role in the degradation of active cytoplasmic enzymes and organelles during nutrient starvation. Macroautophagy involves the formation of double-membrane bound autophagosomes which enclose the cytoplasmic constituent targeted for degradation in a membrane bound structure, which then fuse with the lysosome (or vacuole) releasing a single-membrane bound autophagic bodies which are then degraded within the lysosome (or vacuole). MAP1A and MAP1B are microtubule-associated proteins which mediate the physical interactions between microtubules and components of the cytoskeleton. These proteins are involved in formation of autophagosomal vacuoles (autophagosomes). MAP1A and MAP1B each consist of a heavy chain subunit and multiple light chain subunits. Apg8a is one of the light chain subunits and can associate with either MAP1A or MAP1B. The precursor molecule is cleaved by APG4B/ATG4B to form the cytosolic form, Apg8a-I. This is activated by APG7L/ATG7, transferred to ATG3 and conjugated to phospholipid to form the membrane-bound form, Apg8a-II.

Microautophagy circumvents the autophagosomic step of macrophagy, and begins with the direct uptake of cytosolic material via invaginations and pinching off of the lysosomal membrane. The internalized cytosolic components are digested by lysosomal enzymes released when the vacuolar membrane disintegrates, as in macroautophagy.

In chaperone-mediated autophagy, specific chaperone proteins bind to target proteins containing a KFERQ (SEQ ID NO: 1) sequence and channel these proteins to the surface of the lysosome. These proteins bind to Lamp2a and are then transported across the lysosomal membrane with the assistance of lysosomal chaperones, after which they are degraded by vacuolar proteases.

Mizushima, et al., describes autophagy as promoting both cell survival and cell death. By maintaining homeostasis during times of cellular stress, autophagy generally promotes survival when it is controlled. See Mizushima, N., et al., "Autophagy fights disease through cellular self-digestion" *Nature* (2008) 451:1069-1075.

However, dramatic upregulation of autophagy via Beclin 1 overexpression brings about cell death. Mizushima, et al., describe how the autophagy and apoptosis pathways share many common regulatory factors, with the likelihood of significant cross-talk between these pathways in the cell. Since apoptosis is known to be implicated in human disease, autophagy also is likely an important phenomenon to target in order to treat disease.

Proteins that regulate autophagy in cancer cells make attractive therapeutic and diagnostic targets. Cancer cells rely on autophagy in order to evade anti-cancer treatments designed to reduce nutrient supply and enhance the stress on rapidly dividing cells. A compound that downregulates autophagy may be a useful additional drug in cancer treatment. Mizushima, et al., state that since autophagy may help prevent cancer, there is a potential need to target autophagy in a context-specific manner. The targeting of specific autophagy regulatory proteins rather than a targeting of autophagy in general may be critical in developing a treatment of cancer as well as new modes of diagnosing cancer.

Alterations in the autophagy degradation pathway have been described in normal brain aging and in age-related neurodegenerative diseases including Alzheimer's and Parkinson's diseases. See Nixon, R., "Autophagy in neurodegenerative disease: friend, foe, or turncoat?" *Trends in Neurosciences* (2006) 29(9):528-535. An improper clearance of proteins in these diseases may result either from a compromise in the autophagy degradation pathway or induced alterations in this pathway, and may result in neuron dysfunction and neuron loss. The targeting of specific autophagy regulatory proteins, rather than a targeting of autophagy in general, may be critical in developing a treatment of neurodegenerative diseases as well as new modes of diagnosing neurodegenerative diseases. Therefore, there exists a need to develop an assay to monitor the activity of autophagy proteins that does not rely exclusively on protein localization.

DISCLOSURE OF THE INVENTION

Several of the following aspects provide peptides comprising amino acids that are novel phosphorylation sites on various autophagy proteins. Several of the following aspects also provide antibodies that react specifically to the phosphorylated forms of these proteins, and antibodies that react specifically to the non-phosphorylated forms of these proteins.

In one aspect, the present disclosure provides an isolated autophagy peptide that comprises an amino acid sequence selected from the group consisting of the sequences set forth in Table 1, wherein the x residue is nonphosphorylated or phosphorylated serine, threonine, or tyrosine, and with the proviso that the peptide is not a full-length autophagy protein comprising an amino acid sequence set forth in Table 2. The peptides of this embodiment are referred to as "autophagy peptides".

In some embodiments, an isolated peptide of the present disclosure comprises an amino sequence found in Table 3. The peptides of this embodiment are a subset of possible autophagy peptides.

In another embodiment, isolated peptides of the present disclosure comprise an amino acid sequence found in Table 4. In some embodiments, the x residue may be phosphorylated. In some embodiments, the x residue may be nonphosphorylated.

In another aspect, the disclosure provides for an immunogen, which comprises an autophagy peptide and immune response potentiator.

In another aspect, the disclosure provides for a multiple antigenic peptide (MAP), which comprises a branched oligolysine core conjugated with a plurality of isolated autophagy peptides.

In another aspect, the disclosure provides for a method for producing an antibody to an autophagy polypeptide. The method comprises introducing an isolated autophagy peptide comprising a sequence set forth in Table 1 to a mammal in an amount sufficient to produce an antibody to the autophagy peptide; and recovering the antibody from the mammal.

In another aspect, the disclosure provides for a kit for producing an antibody to an autophagy polypeptide. The kit comprises an isolated autophagy peptide comprising a sequence set forth in Table 1, a means for introducing the isolated autophagy peptide to a mammal in an amount sufficient to produce an antibody to the autophagy peptide, and a means for recovering the antibody from the mammal.

In another aspect, the disclosure provides for a method for producing an antibody to an autophagy polypeptide. The method comprises introducing an autophagy protein to a mammal in an amount sufficient to produce an antibody to the autophagy protein, recovering the antibody from the mammal, and affinity purifying an autophagy antibody that specifically binds to an epitope of the sequence in Table 3. This method is referred to below as the "method for producing an affinity-purified autophagy antibody" In one embodiment, the disclosure provides for an antibody to an autophagy polypeptide produced by this method.

In another aspect, the disclosure provides for a kit for producing an antibody to an autophagy polypeptide. The kit comprises an autophagy protein, a means for introducing the autophagy protein to a mammal in an amount sufficient to produce an antibody to the autophagy polypeptide, a means for recovering the antibody from the mammal, and an isolated autophagy peptide comprising a sequence from Table 1.

In another aspect, the disclosure provides for an isolated antibody that specifically binds to an epitope that comprises the amino acid residue x (also referred to herein as the "X residue") in an amino acid sequence set forth in Table 3, wherein the x residue is either phosphorylated or nonphosphorylated serine, threonine, or tyrosine. In one embodiment, the epitope comprises the amino acid residue x in one amino acid sequence set forth in Table 3 and an amino acid residue of autophagy protein that is outside the same amino acid sequence set forth in Table 3. In another embodiment, the epitope comprises the amino acid residue x in one amino acid sequence set forth in Table 3 and amino acid residues of an autophagy protein that are outside the same amino acid sequence set forth in Table 3.

In another aspect, the disclosure provides for a method for detecting an autophagy protein or fragment comprising an amino acid sequence set forth in Table 4, wherein the x residue is either phosphorylated or nonphosphorylated serine, threonine, or tyrosine, in a sample. The method comprises the following steps. First, a sample containing or suspected of containing an autophagy protein or fragment comprising the amino acid sequence set forth in Table 4, wherein the x residue is either phosphorylated or nonphosphorylated, is contacted with an isolated antibody that specifically binds to an epitope that comprises the amino acid residue x in the amino acid sequence set forth in Table 4, wherein x is either phosphorylated or nonphosphorylated. The next step is assessing a complex formed between the autophagy protein or fragment, if present in the sample, and the antibody, to determine the presence, absence and/or amount of the autophagy protein or fragment in the sample.

In another aspect, the disclosure provides for a kit for detecting an autophagy protein or fragment comprising amino acid sequence set forth in Table 4 wherein x is serine or phosphoserine in a sample, which kit comprises, in a container, an isolated antibody that specifically binds to an epitope that comprises the amino acid residue x in the amino acid sequence set forth in Table 4, wherein x is serine or phosphoserine.

In another aspect, the disclosure provides for a method for treating a disease or disorder associated with abnormal phosphorylation status of an autophagy protein or fragment comprising amino acid sequence set forth in Table 4 wherein the x residue is either phosphorylated or nonphosphorylated, which method comprises administering, to a subject when such a treatment is needed or desired, a sufficient amount of an isolated antibody that specifically binds to an epitope that comprises the x residue in the amino acid sequence set forth in Table 4, wherein x is either phosphorylated or nonphosphorylated.

Another aspect is a method for identifying a kinase that phosphorylates an autophagy protein on the x residue. The method comprises the steps of: (1) providing autophagy polypeptide comprising an amino acid sequence listed in Table 1, wherein x is nonphosphorylated serine, threonine, or tyrosine; (2) contacting the autophagy polypeptide with a test protein and ATP under conditions suitable for the phosphorylation of the x residue of the autophagy polypeptide; and (3) assessing the phosphorylation status of the autophagy polypeptide to determine whether the test protein is a kinase for the autophagy protein on the x residue.

Another aspect is a method for identifying a modulator of a kinase that phosphorylates an autophagy protein on the x residue. The method comprises the steps of: (1) providing an autophagy polypeptide comprising an amino acid sequence selected from a sequence listed in Table 1, wherein the x residue is not phosphorylated; (2) contacting the autophagy polypeptide with a kinase that phosphorylates the protein on the residue indicated by x and ATP under conditions suitable for the phosphorylation of the x residue of the autophagy polypeptide in the presence or absence of a test substance; and assessing and comparing phosphorylation status of the autophagy polypeptide by the kinase to determine whether the test substance modulates the kinase.

Another aspect is a method for identifying a phosphatase that dephosphorylates an autophagy protein on a phosphorylated x residue. The method comprises the steps of: (1) providing an autophagy polypeptide comprising an amino acid sequence selected from the group consisting of a sequence listed in Table 1, wherein x is phosphorylated; (2) contacting the autophagy polypeptide with a test protein and $H_2O$ under conditions suitable for the dephosphorylation of the phosphoserine residue of the autophagy polypeptide; and (3) assessing phosphorylation status of the autophagy polypeptide to determine whether the test protein is a phosphatase for the autophagy polypeptide on the x residue.

Another aspect is a method for identifying a modulator of a kinase that phosphorylates an autophagy protein on the x residue. The method comprises the steps of: (1) providing an autophagy polypeptide comprising an amino acid sequence listed in Table 1, wherein x is nonphosphorylated serine, threonine, or tyrosine; (2) contacting the autophagy polypeptide with a kinase that phosphorylates an autophagy polypeptide on the x residue and ATP under conditions suitable for the phosphorylation of the x residue of the autophagy polypeptide in the presence or absence of a test substance; and (3) assessing and comparing the phosphorylation status of the autophagy polypeptide by the kinase to determine whether the test substance modulates the kinase.

Another aspect is an isolated nucleic acid fragment which is comprised of a sequence of nucleotides encoding an autophagy peptide comprising an amino acid sequence selected from the group consisting of sequences set forth in Table 1, wherein the x residue is nonphosphorylated serine, threonine, or tyrosine. The autophagy peptide is not a full-length autophagy protein comprising an amino acid sequence set forth in Table 2. The nucleic acid may be DNA. The nucleic acid may also be RNA.

Other objects, features, and technical advantages of the present invention will become more apparent from a consideration of the detailed description herein and from the accompanying drawings.

All publications, patents, patent applications, GenBank sequences and ATCC deposits, cited herein are hereby expressly incorporated by reference for all purposes.

MODES OF CARRYING OUT THE INVENTION

Figure 1:
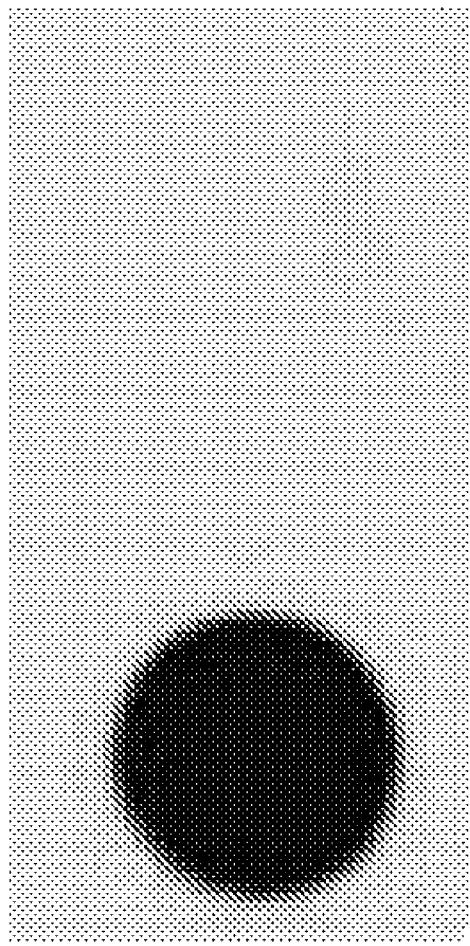
FIG. 1 shows a dot blot of an antibody that specifically binds to APG3L that is phosphorylated at tyrosine-18.

For clarity of disclosure, and not by way of limitation, the detailed description of the invention is divided into the subsections that follow.

Definitions

Unless defined otherwise, all technical and scientific terms used herein have the same meaning as is commonly understood by one of ordinary skill in the art to which this invention belongs. All patents, patent applications (published or unpublished), and other publications referred to herein are incorporated by reference in their entirety. If a definition set forth in this section is contrary to or otherwise inconsistent with a definition set forth in the patents, applications, published applications and other publications that are herein incorporated by reference, the definition set forth in this section prevails over the definition that is incorporated herein by reference.

As used herein, "a" or "an" means "at least one" or "one or more."

As used herein, the term "autophagy protein" refers to one of the following proteins, as indicated by name and an exemplary NCBI accession number: APG-3L (NP_071933), APG4A (NP_443168), APG4B (NP_037457), APG4C (NP_835739), APG4D (NP_116274), APG5L (NP_004840), APG7L (NP_006386), APG8b (NP_073729), APG8c (NP_073729), APG9L1 (NP_076990), APG10L (NP_113670), APG12L (NP_004698), APG16L (NP_110430), and BECN1 (NP_003757).

As used herein, "antibody" is used in the broadest sense. Therefore, an "antibody" can be naturally occurring or man-made such as monoclonal antibodies produced by conventional hybridoma technology and/or a functional fragment thereof. Antibodies of the present invention comprise monoclonal and polyclonal antibodies as well as fragments containing the antigen-binding domain and/or one or more complementarity determining regions of these antibodies. Antibodies can be of any isotype including IgM, IgG, IgD, IgA and IgE, and any sub-Isotype, including IgG1, IgG2a, IgG2b, IgG3 and IgG4, IgE1, IgE2, etc. The light chains of the antibodies can either be kappa light chains or lambda light chains.

As used herein, "monoclonal antibody" refers to an antibody obtained from a population of substantially homogeneous antibodies, i.e., the antibodies comprising the population are identical except for possible naturally occurring mutations that are present in minor amounts. As used herein, a "monoclonal antibody" further refers to functional fragments of monoclonal antibodies.

As used herein, the phrase "oligoclonal antibodies" refers to a predetermined mixture of distinct monoclonal antibodies. See, e.g., PCT publication WO 95/20401; U.S. Pat. Nos. 5,789,208 and 6,335,163.

As used herein, "peptide" includes all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. Routine experimentation will determine whether a mimetic is within the scope of the invention, i.e., that its structure and/or function is not substantially altered.

As used herein, "polypeptide" includes a molecular chain of amino acids linked through peptide bonds. "Polypeptide" does not refer to a specific length of the product. Thus, "peptides," "oligopeptides," and "proteins" are included within the definition of polypeptide.

As used herein, an "antigen", includes any portion of a protein (peptide, protein fragment, full-length protein), wherein the protein is naturally occurring or synthetically derived, a cellular composition (whole cell, cell lysate or disrupted cells), an organism (whole organism, lysate or disrupted cells), a carbohydrate, a lipid, or other molecule, or a portion thereof, wherein the antigen elicits an antigen-specific immune response (humoral and/or cellular immune response).

As used herein, "mammal" refers to any of the mammalian class of species. Frequently, the term "mammal," as used herein, refers to humans, human subjects or human patients.

As used herein, "treatment" means any manner in which the symptoms of a condition, disorder or disease are ameliorated or otherwise beneficially altered. Treatment also encompasses any pharmaceutical use of the compositions herein.

As used herein, "disease or disorder" refers to a pathological condition in an organism resulting from, e.g., infection or genetic defect, and characterized by identifiable symptoms.

As used herein, the term "subject" is not limited to a specific species or sample type. For example, the term "subject" may refer to a patient, and frequently a human patient. However, this term is not limited to humans and thus encompasses a variety of mammalian species.

As used herein, "afflicted" as it relates to a disease or disorder refers to a subject having or directly affected by the designated disease or disorder.

As used herein the term "sample" refers to anything which may contain an analyte for which an analyte assay is desired. The sample may be a biological sample, such as a biological fluid or a biological tissue. Examples of biological fluids include urine, blood, plasma, serum, saliva, semen, stool, sputum, cerebral spinal fluid, tears, mucus, amniotic fluid or the like. Biological tissues are aggregate of cells, usually of a particular kind together with their intercellular substance that form one of the structural materials of a human, animal, plant, bacterial, fungal or viral structure, including connective, epithelium, muscle and nerve tissues. Examples of biological tissues also include organs, tumors, lymph nodes, arteries and individual cell(s).

As used herein, the term "specifically binds" refers to the binding specificity of a specific binding pair. Recognition by an antibody of a particular target in the presence of other potential targets is one characteristic of such binding. "Binding component member" refers to a member of a specific binding pair, i.e., two different molecules wherein one of the molecules specifically binds with the second molecule through chemical or physical means. The two molecules are related in the sense that their binding with each other is such that they are capable of distinguishing their binding partner from other assay constituents having similar characteristics. The members of the binding component pair are referred to as ligand and receptor (antiligand), specific binding pair (sbp) member and sbp partner, and the like. A molecule may also be a sbp member for an aggregation of molecules; for example an antibody raised against an immune complex of a second antibody and its corresponding antigen may be considered to be an sbp member for the immune complex.

As used herein the term "does not specifically bind" refers to the specificity of particular antibodies or antibody fragments. Antibodies or antibody fragments that do not specifically bind a particular moiety generally contain a specificity such that a large percentage of the particular moiety would not be bound by such antibodies or antibody fragments. This percentage generally lies within the acceptable cross reactivity percentage with interfering moieties of assays utilizing antibodies directed to detecting a specific target. Frequently, antibodies or antibody fragments of the present disclosure do not specifically bind greater than about 90% of an interfering moiety, although higher percentages are clearly contemplated and preferred. For example, antibodies or antibody fragments of the present disclosure do not specifically bind about 91%, about 92%, about 93%, about 94%, about 95%, about 96%, about 97%, about 98%, about 99%, and about 99% or more of an interfering moiety. Less occasionally, antibodies or antibody fragments of the present disclosure do not specifically bind greater than about 70%, or greater than about 75%, or greater than about 80%, or greater than about 85% of an interfering moiety.

As used herein the term "isolated" refers to material removed from its original environment, and is altered from its natural state. For example, an isolated polypeptide could be coupled to a carrier, and still be "isolated" because that polypeptide is not in its original environment.

As used herein, the term "X residue" refers to residues of autophagy proteins that are phosphorylation sites, as depicted in Tables 4 and 5. Table 4 shows the site of the x residue, with a label "X". Table 5 shows the x residue in underlined form, with the x residue as threonine, serine, or tyrosine. The phosphorylation state of the x residue is typically described as phosphorylated or nonphosphorylated.

As used herein, the term "autophagy polypeptide" refers to a polypeptide comprising an entire autophagy protein or a fragment of an entire autophagy protein.

As used herein, the term "autophagy peptide" refers to a peptide comprising at least four consecutive amino acid residues of a sequence from Table 4. The "X" residue may be phosphorylated or not phosphorylated.

As used herein, the term "phosphorylated autophagy peptide" refers to an autophagy peptide that is phosphorylated at the x residue.

As used herein, the term "nonphosphorylated" when modifying "autophagy peptide" refer to an autophagy peptide that is not phosphorylated at the x residue.

The titles of each section and the examples of the following specification are not intended to be limiting.

The disclosure is based on the discovery of novel phosphorylation sites in a variety of proteins that play a role in autophagy. Throughout the specification, these proteins are referred to as autophagy proteins, whose names and an exemplary full-length sequence from a species are found in Table 2. The phosphorylation sites are on threonine, serine, and tyrosine residues in the autophagy proteins. Subsequences of these autophagy proteins are listed in Table 5, which further indicates the residue that is phosphorylated as underlined. The phosphorylated residue is represented by the letter x in the peptides shown in Tables 1, 3, and 4.

As a result of the identification of the novel sites of phosphorylation, peptide antigens may now be designed to raise phospho-specific antibodies that bind autophagy proteins when phosphorylated at the residue indicated by the letter x in the peptide ("X residue"). Furthermore, non-phosphospecfic antibodies may be designed that bind autophagy proteins when not phosphorylated at the x residue.

The epitopic site of the antibodies disclosed may be the sequences shown in Tables 1 and 3, with x represented the phosphorylation site as described in these tables. Epitopic sequences may be as short as four bases, with the possible epitopes shown in Table 1. Epitopic sequences may be longer than four bases, with possible epitopes having longer sequence shown in Table 3. Peptides having a sequence that includes the epitopic site are disclosed.

Autophagy Proteins

The following autophagy proteins may play a role in autophagy and are also phosphorylated. Autophagy peptides are comprised of a sequence within the autophagy proteins that encompass the phosphorylation site, which is indicated as an "X". The autophagy peptide may have sequences that correspond to epitopes having sequence set forth in Table 1, wherein the x residue is either phosphorylated or nonphosphorylated serine, threonine, or tyrosine. The autophagy peptide may be comprised of a sequence having at least five residues that is found in Table 3. For any of the above autophagy peptides, the x residue is either phosphorylated or non-phosphorylated.

The autophagy peptide may be comprised of a sequence found in Table 4, in which the x residue is either phosphorylated or nonphosphorylated serine, threonine, or tyrosine. These sequences, as well as the above shorter sequences of this sequence, may be particularly strong antigens for the production of antibodies.

The autophagy peptide comprising the above sequences may not be the full length autophagy protein in any organism that is comprised of a sequence listed in Table 2.

In another embodiment, an isolated peptide of the present disclosure comprises an amino acid sequence set forth in Table 4. In some embodiments, the x residue of serine, threonine, or tyrosine may be nonphosphorylated. In some embodiments, the x residue of serine, threonine, or tyrosine may be phosphorylated.

Pharmaceutical Compositions

In some embodiments, the disclosure provides for a pharmaceutical composition comprising a pharmaceutically acceptable carrier, an excipient, and an isolated autophagy peptide. The pharmaceutical compositions can be used to promote or otherwise enhance the rate of autophagy in vertebrate animals including mammals. Alternatively, the pharmaceutical compositions can be used to inhibit or reduce the rate of autophagy in vertebrate animals, including mammals. Accordingly, the compositions are considered useful for treating or preventing a variety of conditions including ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.

The peptide compounds may be formulated into the compositions as neutral or salt forms. Pharmaceutically acceptable non-toxic salts include the acid addition salts (formed with the free amino groups) and which are formed by reaction with inorganic acids such as, for example, hydrochloric, sulfuric or phosphoric acids, or organic acids such as, for example, acetic, oxalic, tartaric, mandelic, citric, malic, and the like. Salts formed with the free carboxyl groups may be derived from inorganic bases such as, for example, sodium, potassium, ammonium, calcium, or ferric hydroxides, and such organic bases such as amines, i.e., isopropylamine, trimethylamine, 2-ethylamino ethanol, histidine, procaine, and the like.

An autophagy peptide is suitably administered to a subject, e.g., a human or a non-human mammal, such as a domestic animal. The amount administered may vary depending on various factors including, but not limited to, the agent chosen, the disease, and whether prevention or treatment is to be achieved. The peptides may be administered locally or systemically. Administration of the therapeutic agents may be continuous or intermittent, depending, for example, upon the recipient's physiological condition, whether the purpose of the administration is therapeutic or prophylactic, and other factors known to skilled practitioners. The administration of the agents of the invention may be essentially continuous over a preselected period of time or may be in a series of spaced doses.

One or more suitable unit dosage forms comprising an autophagy peptide can be administered by a variety of routes including oral, or parenteral, including by rectal, buccal, vaginal and sublingual, transdermal, subcutaneous, intravenous, intramuscular, intraperitoneal, intrathoracic, intracoronary, intrapulmonary and intranasal routes. The dosage form may optionally be formulated for sustained release. The formulations may, where appropriate, be conveniently presented in discrete unit dosage forms and may be prepared by any of the methods well known to pharmacy. Such methods may include the step of bringing into association the therapeutic agent with liquid carriers, solid matrices, semi-solid carriers, finely divided solid carriers or combinations thereof, and then, if necessary, introducing or shaping the product into the desired delivery system.

When the autophagy peptide is prepared for oral administration, it is preferably combined with a pharmaceutically acceptable carrier, diluent or excipient to form a pharmaceutical formulation, or unit dosage form. The total active ingredients in such formulations comprise from 0.1 to 99.9% by weight of the formulation. By "pharmaceutically acceptable" it is meant the carrier, diluent, excipient, and/or salt must be compatible with the other ingredients of the formulation, and not deleterious to the recipient thereof. The active ingredient for oral administration may be present as a powder or as granules; as a solution, a suspension or an emulsion; or in achievable base such as a synthetic resin for ingestion of the active ingredients from a chewing gum. The active ingredient may also be presented as a bolus, electuary or paste. A useful reference describing pharmaceutically acceptable carriers, diluents and excipients is *Remington's Pharmaceutical Sciences* (Mack Publishing Co. N.J. USA, 1991) which is incorporated herein by reference. Supplementary active compounds can also be incorporated into the compositions.

Pharmaceutical formulations containing an autophagy protein can be prepared by procedures known in the art using well known and readily available ingredients. For example, the natriuretic peptide can be formulated with common excipients, diluents, or carriers, and formed into tablets, capsules, suspensions, powders, and the like. Examples of excipients, diluents, and carriers that are suitable for such formulations include the following fillers and extenders such as starch, sugars, mannitol, and silicic derivatives; binding agents such as carboxymethyl cellulose, HPMC and other cellulose derivatives, alginates, gelatin, and polyvinyl-pyrrolidone; moisturizing agents such as glycerol; disintegrating agents such as calcium carbonate and sodium bicarbonate; agents for retarding dissolution such as paraffin; resorption accelerators such as quaternary ammonium compounds; surface active agents such as cetyl alcohol, glycerol monostearate; adsorptive carriers such as kaolin and bentonite; and lubricants such as talc, calcium and magnesium stearate, and solid polyethyl glycols.

For example, tablets or caplets containing the nucleic acid molecule or peptide of the invention can include buffering agents such as calcium carbonate, magnesium oxide and magnesium carbonate. Caplets and tablets can also include inactive ingredients such as cellulose, pregelatinized starch, silicon dioxide, hydroxy propyl methyl cellulose, magnesium stearate, microcrystalline cellulose, starch, talc, titanium dioxide, benzoic acid, citric acid, corn starch, mineral oil, polypropylene glycol, sodium phosphate, and zinc stearate, and the like. Hard or soft gelatin capsules containing the nucleic acid molecule or peptide of the invention can contain inactive ingredients such as gelatin, microcrystalline cellulose, sodium lauryl sulfate, starch, talc, and titanium dioxide, and the like, as well as liquid vehicles such as polyethylene glycols (PEGs) and vegetable oil. Moreover, enteric coated caplets or tablets of the nucleic acid molecule or peptide of the invention are designed to resist disintegration in the stomach and dissolve in the more neutral to alkaline environment of the duodenum.

The autophagy peptide may be prepared in an injectable formulation. Injectable preparations, for example sterile injectable aqueous or oleaginous suspensions, are formulated according to the known art using suitable dispersing or wetting agents and suspending agents. The sterile injectable preparation can also be a sterile injectable solution or suspension in a nontoxic parenterally acceptable diluent or solvent, for example, as a solution in 1,3-butanediol. Among the acceptable vehicles and solvents that may be employed are water, Ringer's solution, and isotonic sodium chloride solution. In addition, sterile, fixed oils are conventionally employed as a solvent or suspending medium. For this purpose any bland fixed oil can be employed including synthetic mono- or di-glycerides. In addition, fatty acids such as oleic acid find use in the preparation of injectables.

Autophagy Polypeptide Immunogens

The autophagy peptide may be used as an immunogen, with an exemplary use being to generate antibodies. The autophagy peptide may be phosphorylated or not at the residue indicated by x in the sequences of Table 5. In some embodiments, the isolated autophagy peptide of the above embodiments may be conjugated to a carrier to enhance the peptide's immunogenicity. Use of carriers while immunizing the animal is preferred when producing antibodies against an autophagy peptide. It is generally appreciated in the art that antigens must be at least 10 kDa in order to elicit a satisfactory immune response. The size of an antigen can be effectively increased by association of the antigen with a carrier.

The carrier may be a carrier protein. Alternatively, the autophagy peptide and the carrier protein may be part of a fusion protein. Exemplary carriers include, but are not limited to, Keyhole limpet cyanin, BSA, cationized BSA, ovalbumin, blue carrier immunogenic protein, avidin, BTG, bovine G globulin, bovine Immunoglobulin G (BIgG), bovine thyroglobulin, conalbumin, colloidal gold, edestin, exoprotein A (recombinant) from *P. aeruginosa*, hemocyanin from crab *P. camtschatica, Helix promatia Hemocyanin* (HPH), HSA, KTI (Kuntz trypsin inhibitor from soybeans), LPH (*Heamocyanin* from *Limulus polyphemus*), Pam3Cys-Th, polylysine, porcine thyroglobulin (PTG), purified protein derivative (PPD), rabbit serum albumin (RSA), soybean trypsin inhibitor (STI), sunflower globulin (SFG), and Tetanus toxoid. The carrier protein may be coupled to the peptide as described in Lateef, S., et al., *J. Biomol. Tech.* (2007) 8:173-176.

In another aspect, the immunogen may comprise an autophagy polypeptide and an immune response potentiator. In some embodiments, the immune response potentiator may be Bacille Calmette-Guerin (BCG), *Corynebacterium Parvum, Brucella abortus* extract, glucan, levamisole, tilorone, an enzyme or a non-virulent virus.

Multiple Antigenic Peptide

In another aspect, a multiple antigenic peptide (MAP) is provided, which MAP comprises a branched oligolysine core conjugated with a plurality of autophagy polypeptides as described herein. On occasion, the branched oligolysine core comprises 3, 7 or 15 lysine residues, also on occasion, the MAP comprises 4, 8 or 16 copies of the autophagy peptide. The plurality of the autophagy peptide comprises the same or different autophagy peptides. In some embodiments, the plurality of the autophagy peptide is conjugated to the branched oligolysine core via a spacer. Frequently, the spacer may be one or more amino acid residues. Multiple antigenic peptides comprise generally known technology. See, e.g., Adermann, K., et al., *Innovations and Perspectives in Solid Phase Synthesis* 429-432 (R. Epton, ed., Mayflower Worldwide 1994). Furthermore, in some embodiments, the plurality of autophagy peptides is comprised of the same peptide or different peptides.

Method of Producing an Antibody Against an Autophagy Protein

In another aspect is a method for producing an antibody to an autophagy polypeptide. The method comprises introducing an isolated an autophagy peptide into a mammal in an amount sufficient to produce an antibody to the autophagy peptide and recovering the antibody from the mammal. This method and variations thereof in order to enhance antibody specificity can be appreciated by one of skill in the art.

In one embodiment of this aspect, the x residue in the isolated autophagy peptide is not phosphorylated and the method is used to produce an antibody to an autophagy polypeptide that is not phosphorylated at the corresponding serine. In practicing this and subsequent embodiments of this aspect, one of skill in the art may test the specificity of the produced antibody against an autophagy polypeptide phosphorylated or not phosphorylated at the x residue in order to determine specificity.

In another embodiment of this aspect, the x residue in the isolated autophagy peptide is phosphorylated and the method is used to produce an antibody to a phosphorylated autophagy polypeptide. This embodiment may further comprise a step of removing an antibody that binds to an isolated autophagy peptide having a sequence in which the x residue is not phosphorylated.

In some embodiments of the method for producing an autophagy antibody, the isolated autophagy peptide is conjugated to a carrier to enhance the peptide's immunogenicity. Alternatively, in some embodiments, the isolated autophagy peptide is comprised in an immunogen comprised of an isolated autophagy peptide and an immune response potentiator. The carrier, immunogen, and immune response potentiator may be in any of the forms described above.

In another embodiment of the method for producing an autophagy antibody, the isolated autophagy peptide is comprised in a multiple antigenic peptide (MAP), in which the MAP comprises a branched oligolysine core conjugated with a plurality of isolated autophagy peptides. The MAP may be in any of the forms as described above.

Method of Producing an Autophagy Polypeptide Antibody with Subsequent Affinity Purification Another aspect is a method for producing an antibody to an autophagy polypeptide. The method comprises introducing an autophagy polypeptide to a mammal in an amount sufficient to produce an antibody to the autophagy polypeptide, recovering the antibody from the mammal, and affinity purifying an antibody that specifically binds to an epitope having a sequence listed in Table 1. The autophagy polypeptide may be a full-length sequence listed in Table 4. The autophagy polypeptide may be a truncated form of the full-length sequence listed in Table 4 that at least comprises the sequence of the autophagy peptide used in affinity purification. It will be appreciated by one of skill in the art that affinity purification of the antibody leads to an enrichment of antibodies that specifically bind to the autophagy peptide used in affinity purification, as well as a high possibility of enriching for antibodies that bind to epitopes containing phosphorylated "X residues".

In some embodiments of this method, the autophagy polypeptide is nonphosphorylated and the method is used to produce an antibody that specifically binds to a nonphosphorylated autophagy polypeptide. As an example, the autophagy polypeptide used to immunize the animal is not phosphorylated at the x residue and affinity purification is performed using a nonphosphorylated autophagy peptide.

In some embodiments of this method, the x residue in the amino acid sequence set forth in Table 4 of is phosphorylated and the method is used to produce an antibody to a phosphorylated autophagy polypeptide. As an example, the autophagy polypeptide used to immunize the animal is phosphorylated at the x residue and affinity purification is performed using the autophagy polypeptide that is phosphorylated at the x residue. Optionally, this method further comprises a step of removing an antibody that binds to an isolated nonphosphorylated autophagy peptide, wherein x is serine, threonine, or tyrosine. As an example, the antibody sample can be passed through a column containing bound nonphosphorylated autophagy peptide such that antibodies specific to nonphosphorylated autophagy peptide are removed by remaining bound to the column.

Kit for Preparing Antibody to an Autophagy Polypeptide

A kit may be used to prepare an antibody to an autophagy polypeptide. The kit comprises an autophagy protein and a means for introducing the autophagy protein to a mammal in an amount sufficient to produce an antibody to the autophagy polypeptide. The kit also comprises a means for recovering the antibody from the mammal and an isolated autophagy polypeptide comprised of one of the sequences from Table 1. Another embodiment of the kit comprises an autophagy protein and a means for introducing the autophagy protein to a mammal in an amount sufficient to produce an antibody to an autophagy polypeptide.

One exemplary kit contains a full length autophagy protein and reagents containing appropriate immunogens, adjuvants, and buffers such that the autophagy polypeptide can be prepared for introduction into a mammal. The exemplary kit further contains an autophagy polypeptide as well as affinity purification columns that can be used to enrich for antibodies that specifically bind to the autophagy peptide.

Isolated Antibodies

Another aspect is an isolated antibody that specifically binds to an epitope that comprises the x residue in an amino acid sequence set forth in Table 4, wherein x residue is phosphorylated or nonphosphorylated. Multiple embodiments of this aspect are discussed as follows.

In one further embodiment of this aspect, the antibody is a monoclonal or polyclonal antibody or an antibody fragment.

In a further embodiment of this antibody, the epitope of the above antibody comprises both the amino acid residue x in the amino acid sequence set forth in Table 4 and an amino acid residue of the autophagy protein that is outside of the amino acid sequence set forth in Table 4. An exemplary epitope may arise from protein folding in which a residue outside set forth in Table 4 is brought into close proximity with the first epitope. Optionally, a kit may be prepared that is comprised of an antibody of this embodiment, a pharmaceutically acceptable carrier and an excipient.

In a third further embodiment of this antibody, the epitope comprises the amino acid x in the amino acid sequence set forth in Table 4 and amino acid residues of the autophagy protein that are outside of the amino acid sequence set forth in Table 4.

In a fourth further embodiment, the epitope is comprised in the amino acid sequence set forth in Table 4.

In another further embodiment, the epitope is comprised of a sequence set forth in Table 3.

In another further embodiment, the epitope is comprised of a sequence set forth in Table 1.

In another further embodiment, the antibody specifically binds to the epitope that comprises the amino acid residue x in the amino acid sequence set forth in Table 4, wherein the x residue is nonphosphorylated.

In another further embodiment, the antibody specifically binds to the epitope that comprises the amino acid residue x in the amino acid sequence set forth in Table 4, wherein the x residue is phosphorylated.

In another further embodiment, the antibody specifically binds to an epitope comprised in the amino acid sequence set forth in Table 4, wherein the x residue is nonphosphorylated, but does not specifically bind to an epitope comprised in the amino acid sequence of Table 4, wherein the x residue is phosphorylated.

In another further embodiment, the antibody specifically binds to an epitope comprised in the amino acid sequence set forth in Table 4, wherein the x residue of serine, threonine, or tyrosine is phosphorylated, but does not specifically bind to an epitope comprised in the amino acid sequence set forth in Table 4, wherein the x residue of serine, threonine, or tyrosine is nonphosphorylated.

In another further embodiment of this antibody, the amino acid sequence set forth in Table 4 is comprised in an autophagy protein or fragment. In one variation of this embodiment, the antibody specifically binds to the full length autophagy protein when the x residue in a sequence set forth in Table 4 is nonphosphorylated, but does not specifically bind to the full length autophagy protein when the x residue is phosphorylated in the amino acid sequence set forth in Table 4. In another variation of this embodiment, the antibody specifically binds to the full length autophagy protein when the x residue is phosphorylated in the amino acid sequence set forth in Table 4, but does not specifically bind to the full length autophagy protein when the x residue is nonphosphorylated in the amino acid sequence set forth in Table 4. In a third variation of this embodiment, the antibody specifically binds to the full length autophagy protein at its natural conformation.

It will be appreciated by one of skill in the art, that there are many approaches to produce antibodies of this aspect. The following are some exemplary techniques of preparing antibodies.

Antibodies may be prepared using recombinant techniques to generate a Fab fragment that binds to an antigen. The Fab fragment may be generated by sequencing the amino acid residues of a desired monoclonal antibody and determining the sequence of the light chain and the variable and constant regions of the heavy chain that are associated with that particular light chain. Then, two peptides may be designed with these sequences. The peptides may be produced recombinantly in any system, preferably *E. coli* and *B. subtilis*, by designing a vector that contains sequence encoding these two peptides.

Animals are generally required for at least one stage of antibody production. The following exemplary animals may be used: rabbits, chickens, goats, guinea pigs, hamsters, horses, mice, rats, and sheep. Factors governing which animal to choose include: 1) the amount of antibody needed, 2) phylogenetic relationship between the donor of the antigen and the antibody producing animal and 3) the specific desired characteristics of the antibodies. If large amounts of antibody is the overriding concern, then horses, goats, and sheep may be preferred. If a distant phylogenetic relationship is important, then chickens are preferred. Mice and rats are preferred for monoclonal antibody production since only small amounts of antigen are needed to generate antibody producing cells needed for subsequent cloning. Rabbits are a preferred choice for laboratory scale polyclonal antibody production.

Various embodiments of this and other aspects use the following methods to enhance antibody production in an animal: use of carriers (i.e., keyhole limpet cyanin) and immune response potentiators (i.e., multiple antigen peptide such as branched oligolysine).

The amount of antigen used to immunize the animal may vary. Larger amounts of antigen are correlated with higher titer antibody production. For high titer antibody production, the following exemplary amounts of antigen may be used: 250-1,000 micrograms for a rabbit, 50-200 micrograms for a mouse, 150 to 500 micrograms for a guinea pig, 750 to 5,000 micrograms for a goat. Additionally, antibody production may be enhanced by administering small priming doses to an animal before a larger dose as above. The following exemplary amounts of antigen may be used for priming: 50-200 micrograms for a rabbit, 10-50 micrograms for a mouse, 50-500 micrograms for a guinea pig, 250 to 750 micrograms for a goat. Additional amounts of antigen may be administered in the form of a booster, which may be in an amount roughly equal to the priming doses.

Adjuvants may be combined with the antigen in order to stimulate the immune response. Exemplary adjuvants include Freund's complete, Freund's incomplete, Titermax, and Ribi.

Monoclonal antibodies may be produced using phage display techniques. An autophagy polypeptide may be attached to a support medium, such as a column. Phage that express a plurality of antibodies or fragments of antibodies, such as a phage display library, may be exposed to the autophagy polypeptide-bound support medium. An exemplary phage display library used for this purpose is described in Schofield, D., et al., *Genome Biology* (2007) 8(11):R254. Phage that bind to the support may then be further analyzed to determine if they express a molecule that may be an antibody to an autophagy polypeptide. Optionally, a phage display library may be used to isolate an antibody fragment that binds to an autophagy polypeptide. See Teunissen, S., et al., *RNA* (1998) 4:1124-1133, for an example of using phage display to isolate an antibody fragment.

An antibody may also be produced by using a clonal expansion of B cells to isolate an original light chain-heavy chain pairing. An example of this method is described in de Wildt, R., et al., *J. Immunol. Methods* (1997) 207:61-67.

Variant Antibodies

In some embodiments, the antibody can be an intact, four immunoglobulin chain antibody comprising two heavy chains and two light chains. The heavy chain of the antibody can be of any isotype including IgM, IgG, IgE, IgG, IgA or IgD or sub-Isotype including IgG1, IgG2, IgG3, IgG4, IgE1, IgE2, etc. The light chain can be a kappa light chain or a lambda light chain.

In some embodiments, an antibody may have fewer than 4 chains. Such exemplary antibodies include, but are not limited to, single chain antibodies, Camelid antibodies and the like and components of the antibody, including a heavy chain or a light chain. Such exemplary antibodies include small modular immunopharmaceuticals or SMIPs™, Fab and F(ab')$_2$ fragments, etc. These antibodies may be produced by papain or pepsin digestion of antibodies. Papain digestion of antibodies produces two identical antigen-binding fragments, called "Fab" fragments, each with a single antigen-binding site, and a residual "Fc" fragment, whose name reflects its ability to crystallize readily. Pepsin treatment of an antibody yields an F(ab')$_2$ fragment that has two antigen-combining sites and is still capable of cross-linking antigen. The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments that have hinge cysteines between them. Other chemical couplings of antibody fragments are also known.

In some embodiments, the antibody may comprise an "Fv" domain. "Fv" usually refers to the minimum antibody fragment that contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the CDRs confer antigen-binding specificity to the antibody.

In some embodiments, the antibody may have a single variable domain (or half of an Fv comprising three CDRs specific for an antigen), since the single variable domain may have the ability to recognize and bind antigen, although likely at a lower affinity than the entire binding site.

In some embodiments, the antibody comprises a single-chain Fv antibody fragment. "Single-chain Fv" or "scFv" antibody fragments comprise the $V_H$ and $V_L$ domains of an antibody, wherein these domains are present in a single polypeptide chain. In certain embodiments, the Fv polypeptide further comprises a polypeptide linker between the VH and $V_L$ domains that enables the scFv to form the desired structure for antigen binding. For a review of scFv, see Pluckthun in *The Pharmacology of Monoclonal Antibodies*, vol. 113, Rosenburg and Moore, eds. (Springer-Verlag: New York, 1994), pp. 269-315.

In some embodiments, the antibody may comprise a SMIP. SMIPs are a class of single-chain peptides engineered to include a target binding region and effector domain (CH2 and CH3 domains). See, e.g., U.S. Patent Application Publication No. 20050238646. The target binding region may be derived from the variable region or CDRs of an antibody, e.g., a phosphorylation site-specific antibody of the application. Alternatively, the target binding region is derived from a protein that binds a phosphorylation site.

In some embodiments, a therapeutic agent may be placed on one arm of the antibody. The therapeutic agent can be a drug, toxin, enzyme, DNA, radionuclide, etc.

In some embodiments, the antigen-binding fragment can be a diabody. The term "diabody" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404097; WO 93/11161; and Hollinger, et al., *Proc. Natl. Acad. Sci. USA* (1993) 90:6444-6448.

In some embodiments, antibodies may comprise camelid antibodies. Camelid antibodies refer to a unique type of antibodies that are devoid of light chain, initially discovered from animals of the camelid family. The heavy chains of camelid antibodies bind their antigen by one single domain, the variable domain of the heavy immunoglobulin chain, referred to as VHH. VHHs show homology with the variable domain of heavy chains of the human VHIII family. The VHHs obtained from an immunized camel, dromedary, or llama have a number of advantages, such as effective production in microorganisms such as *Saccharomyces cerevisiae*.

In some embodiments, the antibodies can be humanized, chimerized, deimmunized, or fully human. Numerous publications set forth the many types of antibodies and the methods of engineering such antibodies. For example, see U.S. Pat. Nos. 6,355,245; 6,180,370; 5,693,762; 6,407,213; 6,548,640; 5,565,332; 5,225,539; 6,103,889; and 5,260,203. The chimeric antibody is an antibody having portions derived from different antibodies. For example, a chimeric antibody may have a variable region and a constant region derived from two different antibodies. The donor antibodies may be from different species. In certain embodiments, the variable region of a chimeric antibody is non-human, e.g., murine, and the constant region is human.

The genetically altered antibodies used in the invention include CDR grafted humanized antibodies. In one embodiment, the humanized antibody comprises heavy and/or light chain CDRs of a non-human donor immunoglobulin and heavy chain and light chain frameworks and constant regions of a human acceptor immunoglobulin. The method of making humanized antibody is disclosed in U.S. Pat. Nos. 5,530,101; 5,585,089; 5,693,761; 5,693,762; and 6,180,370 each of which is incorporated herein by reference in its entirety.

In some embodiments, the antibody may be an "antigen-binding fragment of an antibody", which is any portion of an antibody that retains specific binding of the intact antibody. An exemplary antigen-binding fragment of an antibody is the heavy chain and/or light chain CDR, or the heavy and/or light chain variable region. Antigen-binding fragments of the antibodies of the invention, which retain the binding specificity of the intact antibody, are also included in the invention. Examples of these antigen-binding fragments include, but are not limited to, partial or full heavy chains or light chains, variable regions, or CDR regions of any phosphorylation site-specific antibodies described herein.

In some embodiments, the antibody may be an immunoglobulin chain comprised in order from 5' to 3', of a variable region and a constant region. The variable region may comprise three complementarity determining regions (CDRs), with interspersed framework (FR) regions for a structure FR1, CDR1, FR2, CDR2, FR3, CDR3 and FR4. In these embodiments, the antibody may further comprise heavy or light chain variable regions, framework regions and CDRs.

In some embodiments, the antibody may comprise a heavy chain constant region that comprises some or all of a CH1 region, hinge, CH2 and CH3 region.

In some embodiments, the antibody may have an binding affinity ($K_D$) of $1\times10^7$ M or less. In other embodiments, the antibody binds with a $K_D$ of $1\times10^8$ M, $1\times10^9$ M, $1\times10^{10}$ M, $1\times10^{11}$ M, $1\times10^{12}$ M or less. In certain embodiments, the KD is 1 pM to 500 pM, between 500 pM to 1 µM, between 1 µM to 100 nM, or between 100 mM to 10 tiM.

In some embodiments, the antibodies may be genetically-altered, wherein the amino acid sequence of the native antibody has been varied. Because of the relevance of recombinant DNA techniques to this application, one need not be confined to the sequences of amino acids found in natural antibodies; antibodies can be redesigned to obtain desired characteristics. The possible variations are many and range from the changing of just one or a few amino acids to the complete redesign of, for example, the variable or constant region. Changes in the constant region may be made in order to improve or alter characteristics, such as complement fixation, interaction with membranes and other effector functions. Changes in the variable region may be made in order to improve the antigen binding characteristics. Modified antibodies may provide improved stability or/and therapeutic efficacy. Examples of modified antibodies include those with conservative substitutions of amino acid residues, and one or more deletions or additions of amino acids that do not significantly deleteriously alter the antigen binding utility. Substitutions can range from changing or modifying one or more amino acid residues to complete redesign of a region as long as the therapeutic utility is maintained. Antibodies can be modified post-translationally (e.g., acetylation, and/or phosphorylation) or can be modified synthetically (e.g., the attachment of a labeling group).

In preferred embodiments, genetically altered antibodies are functionally equivalent to the above-mentioned natural antibodies.

Oligoclonal antibodies may be used in various embodiments. In some embodiments, oligoclonal antibodies consisting of a predetermined mixture of antibodies against one or more epitopes are generated in a single cell. In other embodiments, oligoclonal antibodies comprise a plurality of heavy chains capable of pairing with a common light chain to generate antibodies with multiple specificities (e.g., PCT publication WO 04/009618). It is appreciated by one of skill in the art that oligoclonal antibodies are particularly useful when it is desired to target multiple epitopes on a single target molecule. In view of the assays and epitopes disclosed herein, those skilled in the art can generate or select antibodies or mixtures of antibodies that are applicable for an intended purpose and desired need.

Recombinant antibodies against the novel phosphorylation sites identified in the disclosure may be used in various embodiments. These recombinant antibodies have the same amino acid sequence as the natural antibodies or have altered amino acid sequences of the natural antibodies in the present application. They can be made in any expression systems including both prokaryotic and eukaryotic expression systems or using phage display methods (see, e.g., Dower, et al., WO91/17271 and McCafferty, et al., WO92/01047; U.S. Pat. No. 5,969,108, which are herein incorporated by reference in their entirety).

In some embodiments, antibodies have variant constant or Fc regions. Such antibodies can be useful in modulating effector functions, i.e., antigen-dependent cytotoxicity (ADCC) and complement-dependent cytotoxicity (CDC). Such antibodies may be useful in instances where a parent singling protein is expressed in normal tissue; variant antibodies without effector function in these instances may elicit the desired therapeutic response while not damaging normal tissue.

In some embodiments, the antibody fragments are truncated chains (truncated at the carboxyl end). These truncated chains may possess one or more immunoglobulin activities (e.g., complement fixation activity). Examples of truncated chains include, but are not limited to, Fab fragments (consisting of the VL, VH, CL and CH1 domains); Fd fragments (consisting of the VH and CH1 domains); Fv fragments (consisting of VL and VH domains of a single chain of an antibody); dAb fragments (consisting of a VH domain); isolated CDR regions; $(FaW)_2$ fragments, bivalent fragments (comprising two Fab fragments linked by a disulphide bridge at the hinge region). The truncated chains can be produced by conventional biochemical techniques, such as enzyme cleavage, or recombinant DNA techniques, each of which is known in the art. These polypeptide fragments may be produced by proteolytic cleavage of intact antibodies by methods well known in the art, or by inserting stop codons at the desired locations in the vectors using site-directed mutagenesis, such as after CH1 to produce Fab fragments or after the hinge region to produce $(Fab')_2$ fragments. Single chain antibodies may be produced by joining VL- and VH-coding regions with a DNA that encodes a peptide linker connecting the VL and VH protein fragments.

In some embodiments, single chain antibodies, and chimeric, humanized or primatized (CDR-grafted) antibodies, as well as chimeric or CDR-grafted single chain antibodies, comprising portions derived from different species, are also encompassed by the present disclosure as antigen-binding fragments of an antibody. The various portions of these antibodies can be joined together chemically by conventional techniques, or can be prepared as a contiguous protein using genetic engineering techniques. For example, nucleic acids encoding a chimeric or humanized chain can be expressed to produce a contiguous protein. See, e.g., U.S. Pat. Nos. 4,816,567 and 6,331,415; 4,816,397; European Patent No. 0,120,694; WO86/01533; European Patent No. 0,194,276 B1; U.S. Pat. No. 5,225,539; and European Patent No. 0,239,400 B1. See also, Newman, et al., *BioTechnology* (1992) 10:1455-1460, regarding primatized antibody. See, e.g., Ladner, et al., U.S. Pat. No. 4,946,778; and Bird, et al., *Science* (1988) 242:423-426), regarding single chain antibodies.

In addition, functional fragments of antibodies, including fragments of chimeric, humanized, primatized or single chain antibodies, can also be produced. Functional fragments of the subject antibodies retain at least one binding function and/or modulation function of the full-length antibody from which they are derived.

Since the immunoglobulin-related genes contain separate functional regions, each having one or more distinct biological activities, the genes of the antibody fragments may be fused to functional regions from other genes (e.g., enzymes, U.S. Pat. No. 5,004,692, which is incorporated by reference in its entirety) to produce fusion proteins or conjugates having novel properties.

In some embodiments, non-Immunoglobulin binding polypeptides are also contemplated. For example, CDRs from an antibody disclosed herein may be inserted into a suitable non-Immunoglobulin scaffold to create a non-immunoglobulin binding polypeptide. Suitable candidate scaffold structures may be derived from, for example, members of fibronectin type III and cadherin superfamilies.

Some embodiments may comprise other equivalent non-antibody molecules, such as protein binding domains or aptamers, which bind, in a phospho-specific manner, to an amino acid sequence comprising a novel phosphorylation site of the invention. See, e.g., Neuberger, et al., *Nature* (1984) 312:604. Aptamers are oligonucleic acid or peptide molecules that bind a specific target molecule. DNA or RNA aptamers are typically short oligonucleotides, engineered through repeated rounds of selection to bind to a molecular target. Peptide aptamers typically consist of a variable peptide loop attached at both ends to a protein scaffold. This double structural constraint generally increases the binding affinity of the peptide aptamer to levels comparable to an antibody (nanomolar range).

In some embodiments, phosphorylation site-specific antibodies may be conjugated with immunotoxins. Conjugates that are immunotoxins including antibodies have been widely described in the art. The toxins may be coupled to the antibodies by conventional coupling techniques or immunotoxins containing protein toxin portions can be produced as fusion proteins. In certain embodiments, antibody conjugates may comprise stable linkers and may release cytotoxic agents inside cells (see U.S. Pat. Nos. 6,867,007 and 6,884,869). The conjugates of the present application can be used in a corresponding way to obtain such immunotoxins. Illustrative of such immunotoxins are those described by Byers, et al., *Seminars Cell Biol* (1991) 2:59-70 and by Fanger, et al., *Immunol Today* (1991) 12:51-54. Exemplary immunotoxins include radiotherapeutic agents, ribosome-Inactivating proteins (RIPs), chemotherapeutic agents, toxic peptides, or toxic proteins.

Antibody Pharmaceutical Compositions

Another aspect is a pharmaceutical composition that comprises an antibody of any other aspect disclosed. The pharmaceutical composition may further comprise a carrier. Suitable carriers include any material that when combined with the therapeutic composition retains the anti-tumor function of the therapeutic composition and is generally non-reactive with the patient's immune system. Examples include, but are not limited to, any of a number of standard pharmaceutical carriers such as sterile phosphate buffered saline solutions, bacteriostatic water, and the like (see, generally, *Remington's Pharmaceutical Sciences*, 16th Edition, A. Osal., Ed., 1980). PEG may be used as a pharmaceutical carrier. PEG may be covalently attached to the antibody in the pharmaceutical composition.

Method for Detecting an Autophagy Protein

Another aspect is a method for detecting an autophagy protein or fragment comprising an amino acid sequence set forth in Table 4, wherein the x residue is either phosphorylated or nonphosphorylated, in a sample. The method comprises contacting a sample containing or suspected of containing an autophagy protein or fragment comprising the amino acid sequence set forth in Table 4, wherein the x residue is either phosphorylated or nonphosphorylated serine, threonine, or tyrosine, with an isolated antibody that specifically binds to an epitope that comprises the x residue of the sequence set forth in Table 4, wherein x is either phosphorylated or nonphosphorylated; and assessing a complex formed between the autophagy protein or fragment, if present in the sample, and the antibody, to determine the presence, absence and/or amount of the autophagy protein or fragment in the sample.

In an embodiment of this method, the epitope comprises the amino acid residue x in the sequence set forth in Table 4 and an amino acid residue of the autophagy protein that is outside the amino acid sequence set forth in Table 4.

In another embodiment of this method, the epitope comprises the amino acid residue x in the amino acid sequence set forth in Table 4 and amino acid residues of the autophagy protein that are outside the amino acid sequence set forth in Table 4.

In some embodiments, the epitope is comprised in the amino acid sequence set forth in Table 4.

In some embodiments, the epitope is comprised in an amino acid sequence set forth in Table 3.

In some embodiments, the epitope is comprised in an amino acid sequence selected from the group consisting of a sequence set forth in Table 1.

In another embodiment, the isolated antibody specifically binds to the epitope that comprises the x residue in the amino acid sequence set forth in Table 4, wherein x is not phosphorylated.

In another embodiment, the isolated antibody specifically binds to the epitope that comprises the amino acid residue x in the amino acid sequence set forth in Table 4, wherein x is phosphorylated.

In another embodiment, the isolated antibody specifically binds to an epitope comprised in an amino acid sequence set forth in Table 4, wherein the x residue is not phosphorylated. The antibody does not specifically bind to an epitope comprised in the amino acid sequence set forth in Table 4, wherein the x residue is phosphorylated.

In another embodiment, the isolated antibody specifically binds to an epitope comprised in the amino acid sequence set forth in Table 4, wherein the x residue is phosphorylated. The antibody does not specifically bind to an epitope comprised in the amino acid sequence set forth in Table 4, wherein the x residue is not phosphorylated.

In another embodiment, the isolated antibody specifically binds to the full length autophagy protein at its natural conformation.

In another embodiment, the isolated antibody is a monoclonal or polyclonal antibody or antibody fragment.

In another embodiment, the complex is assessed by a format selected from the group consisting of an enzyme-linked immunosorbent assay (ELISA), immunoblotting, immunoprecipitation, radioimmunoassay (RIA), immunostaining, latex agglutination, indirect hemagglutination assay (IHA), complement fixation, indirect immunofluorescent assay (IFA), nephelometry, flow cytometry assay, plasmon resonance assay, chemiluminescence assay, lateral flow immunoassay, u-capture assay, inhibition assay and avidity assay.

In another embodiment, the complex is assessed in a homogeneous or a heterogeneous assay format.

Immunoassay

Although a variety of assay types are contemplated, the present methods frequently assess the complex formed between a full-length autophagy protein and the antibody via a sandwich or competitive assay format. On occasion, the complex is assessed in a homogeneous or a heterogeneous assay format. Also frequently, the complex is assessed by a format selected from the group consisting of an enzyme-linked immunosorbent assay (ELISA), immunoblotting, immunoprecipitation, radioimmunoassay (RIA), immunostaining, latex agglutination, indirect hemagglutination assay (IHA), complement fixation, indirect immunofluorescent assay (IFA), nephelometry, flow cytometry assay, plasmon resonance assay, chemiluminescence assay, lateral flow immunoassay, u-capture assay, inhibition assay and avidity assay.

In a sandwich assay format, the antibody that that specifically binds to an epitope that comprises the amino acid residue x in the amino acid sequence set forth in Table 4 is used as a first antibody. The antibody that is capable of binding to a portion of full-length autophagy protein other than a sequence set forth in Table 4, which binds to the first antibody, is used as a second antibody. Alternatively, in a sandwich assay, the antibody that that specifically binds to an epitope that comprises the amino acid residue x in an amino acid sequence set forth in Table 4 is used as a first antibody. The antibody that is capable of binding to a portion of whole autophagy polypeptide other than the sequence set forth in Table 4, which binds to the first antibody, is used as a second antibody.

Either the first antibody or the second antibody is frequently attached to a surface and functions as a capture antibody. The attachment can be direct or indirect. In a preferred embodiment, the attachment is provided via a biotin-avidin (or streptavidin) linking pair.

Determination of Phosphorylation Status

Phosphorylation site-specific binding molecules are disclosed that specifically bind at novel phosphorylation sites in various autophagy protein molecules set forth in Table 2. These molecules distinguish between the phosphorylated and unphosphorylated forms. In one embodiment, the binding molecule is an antibody or an antigen-binding fragment thereof. The antibody may specifically bind to an amino acid sequence comprising a phosphorylation site identified by "X" in each of the sequences set forth in Table 3.

In this aspect is a method to determine the phosphorylation status of an autophagy protein or fragment by detecting a polypeptide comprising the amino acid sequence set forth in Table 4. The method comprises contacting a sample containing or suspected of containing this protein with an isolated antibody that specifically binds to an epitope that comprises the x residue in the sequence set forth in Table 4. The antibody may recognize either the phosphorylated or nonphosphorylated form of this epitope, i.e., serine, threonine, tyrosine or phosphoserine, phosphoserine, or phosphotyrosine. The method further comprises a step of assessing a complex formed between the autophagy protein or fragment, if present in the sample, to determine the phosphorylation status of the autophagy protein.

An example of this embodiment involves using two antibodies, one that specifically recognizes serine and one that specifically recognizes phosphoserine. It can be appreciated that one of skill in the art can measure the phosphorylation status by determining the relative degree of staining of the two antibodies in various standards containing known amounts of phosphorylated and nonphosphorylated autophagy peptides to determine the phosphorylation status of an autophagy protein.

A further embodiment of this aspect is to determine the phosphorylation status of a full length autophagy protein. Optionally, this embodiment is used to determine the phosphorylation status of a full length autophagy protein in a biological sample. The biological sample may be a clinical sample. The determination of the phosphorylation status of an autophagy protein, or optionally a full length autophagy protein, in a biological sample may be conducted for the prognosis, diagnosis and/or treatment monitoring of a disease or disorder associated with abnormal phosphorylation status of a autophagy protein or fragment comprising an amino acid sequence set forth in Table 4.

Exemplary diseases associated with abnormal phosphorylation level of an autophagy protein or fragment may include ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.

Method for Identifying a Phosphatase

Another aspect is a method for identifying a phosphatase that dephosphorylates an autophagy polypeptide on the x residue. The method comprises the following steps: (1) providing an autophagy polypeptide comprising an amino acid sequence set forth in Table 1, wherein the x residue is phosphorylated, (2) contacting the autophagy polypeptide with a test protein and $H_2O$ under conditions suitable for the dephosphorylation of the phosphoserine residue of the autophagy polypeptide; and (3) assessing the phosphorylation status of the autophagy polypeptide to determine whether the test protein is a phosphatase for the autophagy protein at the x residue.

In a further embodiment, the autophagy protein or fragment comprises an amino acid sequence set forth in Table 4 wherein the x residue is phosphorylated. Optionally, the phosphorylation status of the autophagy polypeptide is assessed by an isolated antibody that specifically binds to an epitope comprised in an amino acid sequence set forth in Table 4 wherein the x residue is not phosphorylated, but does not specifically bind to an epitope comprised of the same amino acid sequence set forth in Table 4, wherein the x residue is phosphorylated. An example of this embodiment is the detection of a nonphosphorylated autophagy protein by detecting binding of an antibody that specifically binds to the nonphosphorylated epitope and does not bind to the phosphorylated epitope.

Method for Identifying a Phosphatase Modulator

Another aspect is a method for identifying a modulator of a phosphatase that dephosphorylates an autophagy protein on the x residue. The method comprises the following steps: (1) providing an autophagy polypeptide comprising an amino acid sequence selected from Table 1, wherein the x residue is phosphorylated; (2) contacting the autophagy polypeptide with a phosphatase that dephosphorylates the autophagy polypeptide on the x residue and $H_2O$ under conditions suitable for the dephosphorylation of the phosphorylated x residue of the autophagy polypeptide in the presence or absence of a test substance; and (3) assessing and comparing dephosphorylation status of the autophagy polypeptide by the phosphatase to determine whether the test substance modulates the phosphatase.

In a further embodiment of this aspect, the autophagy protein or fragment comprises an amino acid sequence from Table 4 wherein the x residue is phosphorylated. Optionally, the phosphorylation status of the autophagy polypeptide is assessed by an isolated antibody that specifically binds to an epitope comprised in the amino acid sequence from Table 4, wherein the x residue is not phosphorylated, but does not specifically bind to an epitope comprised in the amino acid sequence from Table 4, wherein the x residue is phosphorylated.

Kit for Protein Detection

In another aspect is a kit for detecting an autophagy protein or fragment comprising an amino acid sequence from Table 4, wherein the x residue is either phosphorylated or nonphosphorylated, in a sample. The kit comprises, in a container, an isolated antibody that specifically binds to an epitope that comprises the amino acid residue x in the amino acid sequence from Table 4, wherein x is serine or phosphoserine.

An exemplary use of the kit is to specifically detect a native autophagy protein that is phosphorylated at the x residue. Another exemplary use of the kit is to specifically detect native autophagy protein that is not phosphorylated at the x residue.

Method of Treating Disease

The following aspect relates to a method of treating a disease or disorder associated with abnormal phosphorylation status of an autophagy protein or fragment comprising amino acid sequence from Table 4, wherein the x residue of serine, threonine, or tyrosine is phosphorylated or nonphosphorylated. The method comprises administering, to a subject when such a treatment is needed or desired, a sufficient amount of an isolated antibody that specifically binds to an epitope that comprises the amino acid residue x in the amino acid sequence set forth in Table 4, wherein the x residue is phosphorylated or nonphosphorylated. The subject may be a mammal. The subject may be a human.

In some embodiments, the isolated antibody specifically binds to the full length autophagy protein at its natural conformation.

In some embodiments, the isolated antibody is a monoclonal or polyclonal antibody or antibody fragment.

Some embodiments further comprise the step of administering a pharmaceutically acceptable carrier and excipient.

In one embodiment of the above aspect the isolated antibody specifically binds to an epitope comprised in the amino acid sequence set forth in Table 4, wherein x is not phosphorylated, but does not specifically bind to an epitope comprised in the amino acid sequence set forth in Table 4, wherein x is phosphorylated. Optionally, the disease or disorder is associated with abnormal phosphorylation level of an autophagy protein or fragment, and the binding of the antibody to the autophagy protein or fragment prevents or reduces the phosphorylation level of the autophagy protein or fragment. As a further option, the diseases or disorders associated with abnormal phosphorylation level of an autophagy protein or fragment are ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.

In another embodiment of the above aspect, the isolated antibody specifically binds to an epitope comprised in the amino acid sequence set forth in Table 4, wherein the x residue is phosphorylated, but does not specifically bind to an epitope comprised in the amino acid sequence set forth in Table 4, wherein the x residue is not phosphorylated. Optionally, the disease or disorder is associated with abnormally low phosphorylation level of an autophagy protein or fragment, and the binding of the antibody to the autophagy protein or fragment prevents or reduces dephosphorylation of the autophagy protein or fragment. As a further option, the disease or disorder associated with abnormally low phosphorylation level of an autophagy protein or fragment are ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.

In another embodiment of the above aspect, the amino acid sequence of a sequence from Table 4 is comprised in a full length autophagy protein and the isolated antibody specifically binds to the full length autophagy protein. As a first option, the isolated antibody specifically binds to the full length autophagy protein when the x residue is not phosphorylated in the amino acid sequence set forth in Table 4, but does not specifically bind to the full length autophagy protein when the x residue is phosphorylated in the amino acid sequence set forth in Table 4. As a second option, the isolated antibody specifically binds to the full length autophagy protein when the x residue is phosphorylated in the amino acid sequence set forth in Table 4, but does not specifically bind to the full length autophagy protein when the x residue is not phosphorylated in the amino acid sequence set forth in Table 4.

Identification of a Kinase

Another aspect is a method for identifying a kinase that phosphorylates an autophagy protein on the phosphorylation site indicated by the x residue. The method comprises the steps of (1) providing an autophagy polypeptide comprising an amino acid sequence selected from Table 1, wherein the x residue is not phosphorylated; (2) contacting the autophagy polypeptide with a test protein and ATP under conditions suitable for the phosphorylation of the serine residue of the autophagy polypeptide; and (3) assessing the phosphorylation status of the autophagy polypeptide to determine whether the test protein is a kinase for the autophagy protein on the x residue.

In another embodiment of this aspect, the autophagy protein or fragment comprises an amino acid sequence set forth in Table 4 wherein the x residue is not phosphorylated.

In another embodiment, the phosphorylation status of the autophagy polypeptide is assessed by an isolated antibody that specifically binds to an epitope comprised in the amino acid sequence set forth in Table 4, wherein the x residue is phosphorylated, but does not specifically bind to an epitope comprised in the amino acid sequence set forth in Table 4, wherein the x residue is not phosphorylated.

Identification of a Kinase Modulator

Another aspect is a method for identifying a modulator of a kinase that phosphorylates an autophagy protein on the x residue. The method comprises the steps of: (1) providing an autophagy polypeptide comprising an amino acid sequence selected from Table 1, wherein x is not phosphorylated; (2) contacting the autophagy polypeptide with a kinase that phosphorylates the autophagy polypeptide on the x residue and ATP under conditions suitable for the phosphorylation of the x residue of the autophagy polypeptide in the presence or absence of a test substance; and (3) assessing and comparing phosphorylation status of the autophagy polypeptide by the kinase to determine whether the test substance modulates the kinase.

In one embodiment of this aspect, the autophagy protein or fragment comprises an amino acid sequence set forth in Table 4, wherein x is serine.

In another embodiment of this aspect, the phosphorylation status of the autophagy polypeptide is assessed by an isolated antibody that specifically binds to an epitope comprised in the amino acid sequence set forth in Table 4, wherein the x residue is phosphorylated, but does not specifically bind to an epitope comprised in the amino acid sequence set forth in Table 4, wherein x is not phosphorylated.

Isolated Nucleic Acid Fragment

Another aspect is an isolated nucleic acid fragment which is comprised of a sequence of nucleotides encoding an autophagy peptide comprising an amino acid sequence selected from Table 1, wherein x is not phosphorylated. The autophagy peptide is not a full-length autophagy protein comprising an amino acid sequence set forth in Table 2. The nucleic acid may be DNA. The nucleic acid may also be RNA.

In another embodiment, the autophagy peptide comprises an amino acid sequence set forth in Table 4.

In another embodiment there is a plasmid which comprises the nucleic acid fragments of this aspect.

In another embodiment there is a vector which comprises the nucleic acid fragments of this aspect.

In another embodiment, there may be a cell which comprises the plasmids or vectors of this aspect. The cell may be a bacterial cell, a yeast cell, a fungal cell, a plant cell, an insect cell, an animal cell or a human cell. The cell may be used in a method for producing an autophagy peptide, comprising growing the cell of claim 112 under conditions whereby the autophagy peptide is expressed by the cell, and recovering the expressed autophagy peptide. Optionally, the method further comprises a step of phosphorylating the autophagy peptide at the x residue (as indicated in Tables 4 and 5).

Screening for Compounds

In another aspect is a method for identifying a compound that binds to specifically to an autophagy polypeptide phosphorylated at the x residue. The method comprises the following steps: 1) providing a phosphorylated autophagy polypeptide comprising an amino acid sequence selected from Table 1, wherein the x residue is phosphorylated; 2) contacting the phosphorylated autophagy polypeptide with a test compound and $H_2O$ under conditions suitable for binding of the test protein with the autophagy polypeptide; 3) assessing binding of the phosphorylated autophagy polypeptide with the test compound; 4) providing a nonphosphorylated autophagy polypeptide comprising an amino acid sequence selected from Table 1, wherein the x residue is phosphorylated; 5) contacting the nonphosphorylated autophagy polypeptide with a test compound and $H_2O$ under conditions suitable for binding of the test protein with the autophagy polypeptide; and 6) assessing binding of the nonphosphorylated autophagy polypeptide with the test compound. In the method, the compound that binds specifically to a phosphorylated autophagy polypeptide is a test compound which binds to phosphorylated autophagy polypeptide according to step 3 but does not bind to nonphosphorylated autophagy polypeptide according to step 5. In some embodiments, the test compound may be a polypeptide. In some embodiments, the test compound may be a peptide. In some embodiments the test compound may be a nucleic acid. In some embodiments, the compound may be a small molecule.

In another aspect is a method for identifying a compound that binds to specifically to an autophagy polypeptide that is not phosphorylated at the x residue. The method comprises the following steps: 1) providing a nonphosphorylated autophagy polypeptide comprising an amino acid sequence selected from Table 1, wherein x is serine; 2) contacting the nonphosphorylated autophagy polypeptide with a test compound and $H_2O$ under conditions suitable for binding of the test protein with the autophagy polypeptide; 3) assessing binding of the nonphosphorylated autophagy polypeptide with the test compound; 4) providing a phosphorylated autophagy polypeptide comprising an amino acid sequence selected from Table 1, wherein the x residue is phosphorylated; 5) contacting the phosphorylated autophagy polypeptide with a test compound and $H_2O$ under conditions suitable for binding of the test protein with the autophagy polypeptide; and 6) assessing binding of the phosphorylated autophagy polypeptide with the test compound. In the method, the compound that binds specifically to a nonphosphorylated autophagy polypeptide is a test compound which binds to nonphosphorylated autophagy polypeptide according to step 3, but does not bind to the phosphorylated autophagy polypeptide according to step 5. In some embodiments, the test compound may be a polypeptide. In some embodiments, the test compound may be a peptide. In some embodiments the test compound may be a nucleic acid. In some embodiments, the compound may be a small molecule.

Method of Treating Disease by Modulating Phosphorylation of an Autophagy Polypeptide Diseases may be treated by modulating the phosphorylation of an autophagy polypeptide. These diseases may arise from abnormal phosphorylation of the autophagy polypeptide. Alternatively, the phosphorylation status of an autophagy polypeptide may be normal, but the disease may be treated by modulating the phosphorylation of an autophagy polypeptide to enhance or reduce autophagy. Such exemplary diseases include ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.

By increasing the rate of autophagy, there can be enhanced cleaning and turnover of damaged organelles, protein aggregates, and other unwanted cellular features that can be removed by autophagy. By decreasing the rate of autophagy, a diseased cell, such as a cancer cell, may be more susceptible to treatment by chemotherapeutic and other agents.

Autophagy polypeptide phosphorylation may be increased in order to increase autophagy.

Alternatively, autophagy polypeptide phosphorylation may be decreased in order to decrease autophagy.

Autophagy polypeptide phosphorylation may be decreased in order to increase autophagy.

Alternatively, autophagy polypeptide phosphorylation may be increased in order to decrease autophagy.

Antibody Microarrays

In another aspect is a microarray comprising an antibody disclosed above. Microarrays are useful for screening potential binding partners for binding to proteins on an array, in a high-throughput manner. Microarrays are typically comprised of a large number of a library of target or capture reagents robotically arrayed or spotted in high density onto a solid support. Potential binding partners for screening are labeled, usually with fluorescence, and contacted with to a target or capture reagent immobilized on the array under conditions to allow for binding. Following a wash step, binding to the individual targets may be measured and quantified. Each collection of binding partners may be tested individually, with results from individual arrays compared.

An antibody microarray using antibodies of the present invention has substantial utility. The microarray may be used as a diagnostic tool to monitor the phosphorylation of autophagy proteins in a variety of tissue samples from a patient in order to determine whether the patient has a disease that is correlated with an abnormal degree of autophagy. Additionally, the microarray may be used to screen for drugs and other compounds that affect the phosphorylation status of autophagy proteins.

EXAMPLE 1

Production of an APG3L Tyrosine-18 Phosphospecific Polyclonal Antibody

A 12 amino acid phospho-peptide antigen, LEVAEY*LTPVLC (where Y*=phosphotyrosine) (SEQ ID NO: 2), corresponding to residues 13-23 of human APG3L plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto LEVAEYLTPVLC (SEQ ID NO: 3)-resin Knotes column. The flow through fraction was collected and applied onto LEVAEY*LTPVLC (SEQ ID NO: 2)-resin column. After washing the column extensively, the phospho-APG3L-Y18 antibodies were eluted and kept in antibody storage buffer.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG3L-Y18 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 1. As shown in this Figure, the antibody, as expected, only recognized the phosphorylated peptide. It did not recognize the non-phosphorylated peptide.

EXAMPLE 2

Production of an APG4A Serine-100 Phosphospecific Polyclonal Antibody

A 12 amino acid phospho-peptide antigen, LGRDWS*WEKQKC (SEQ ID NO: 4) (where S*=phosphoserine), corresponding to residues 95-105 of human APG4A plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto LGRD-WSWEKQKC (SEQ ID NO: 5)-resin Knotes column. The flow through fraction was collected and applied onto LGRDWS*WEKQKC (SEQ ID NO: 4)-resin column. After washing the column extensively, the phospho-APG4A-S100 antibodies were eluted and kept in antibody storage buffer.

Figure 2:
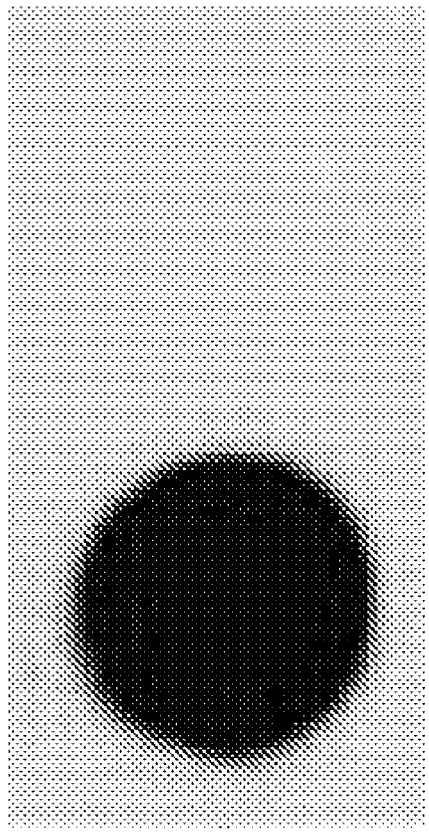
FIG. 2 shows a dot blot of an antibody that specifically binds to APG4A that is phosphorylated at serine-100.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4A-S100 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 2. As shown in this Figure, the antibody, as expected, only recognized the phosphorylated peptide. It did not recognize the non-phosphorylated peptide.

EXAMPLE 3

Production of an APG4C Serine-166 Phosphospecific Polyclonal Antibody

A 12 amino acid phospho-peptide antigen, FEASLS*GEREFC (SEQ ID NO: 6)(where S*=phosphoserine), corresponding to residues 161-171 of human APG4C plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto FEASLS-GEREFC (SEQ ID NO: 7)-resin Knotes column. The flow through fraction was collected and applied onto FEASLS*GEREFC (SEQ ID NO: 6)-resin column. After washing the column extensively, the phospho-APG4C-S166 antibodies were eluted and kept in antibody storage buffer.

Figure 3:
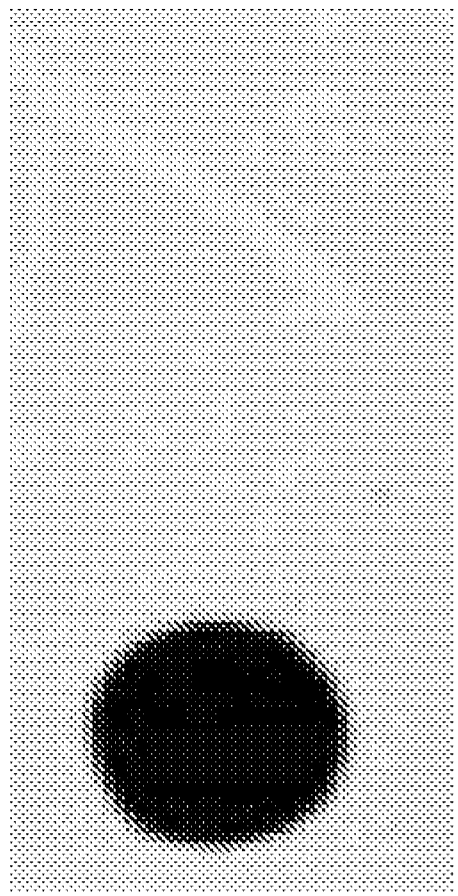
FIG. 3 shows a dot blot of an antibody that specifically binds to APG4C that is phosphorylated at serine-166.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4C-S166 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 3. As shown in this Figure, the antibody, as expected, only recognized the phosphorylated peptide. It did not recognize the non-phosphorylated peptide.

EXAMPLE 4

Production of an APG4C Serine-177 Phosphospecific Polyclonal Antibody

A 12 amino acid phospho-peptide antigen, KTPTIS*LKETIC (SEQ ID NO: 8)(where S*=phosphoserine), corresponding to residues 172-182 of human APG4C plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto KTPTISLKETIC (SEQ ID NO: 9)-resin Knotes column. The flow through fraction was collected and applied onto KTPTIS*LKETIC (SEQ ID NO: 8)-resin column. After washing the column extensively, the phospho-APG4C-S177 antibodies were eluted and kept in antibody storage buffer.

Figure 4:
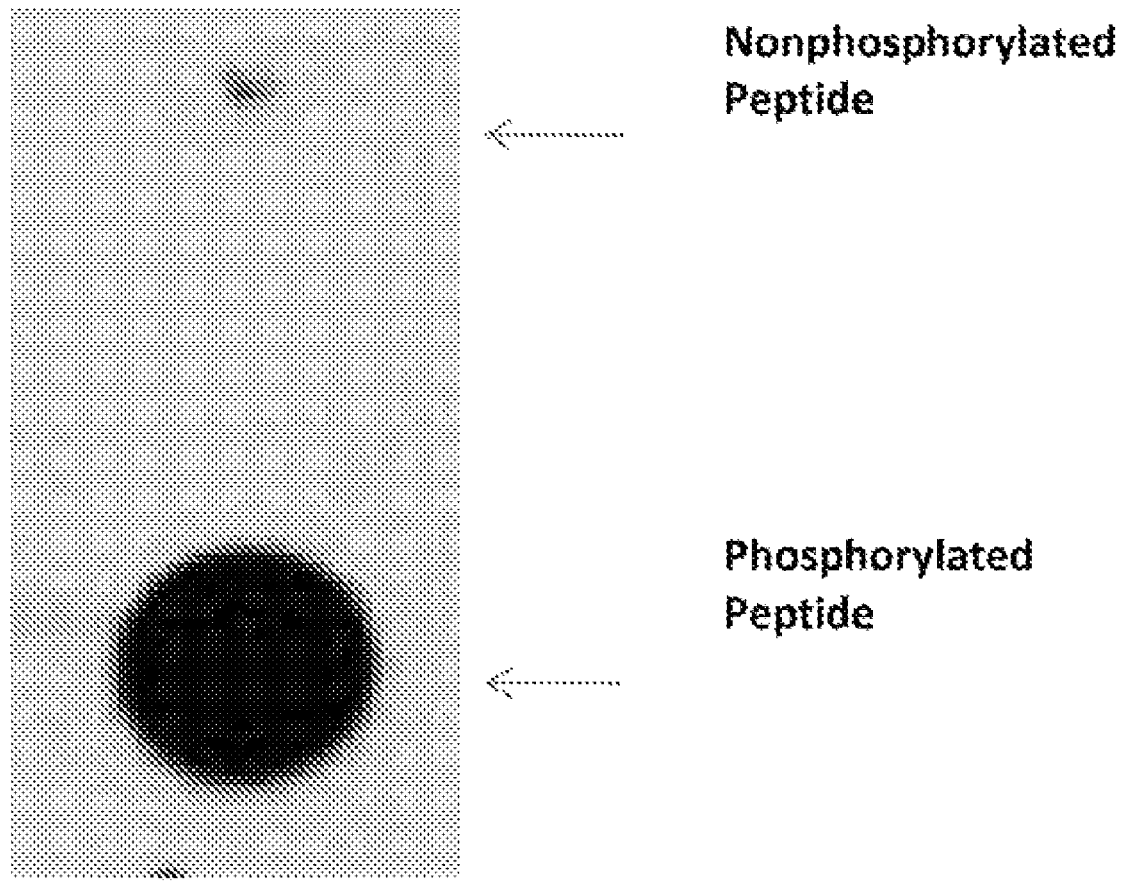
FIG. 4 shows a dot blot of an antibody that specifically binds to APG4C that is phosphorylated at serine-177.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4C-S177 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saranwrap after removing excess solution from the surface, and then exposed to X-ray film in a dark room at several different lengths of exposure. The results of the dot blot is shown in FIG. 4. As shown in this Figure, the antibody, as expected, only recognized the phosphorylated peptide. It did not recognize the non-phosphorylated peptide.

EXAMPLE 5

Production of an APG4C Serine-398 Phosphospecific Polyclonal Antibody

A 12 amino acid phospho-peptide antigen, CDFKRAS*EEITK (SEQ ID NO: 10)(where S*=phosphoserine), corresponding to residues 393-403 of human APG4C plus cysteine on the N-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto CDFKRASEEITK (SEQ ID NO: 11)-resin Knotes column. The flow through fraction was collected and applied onto CDFKRAS*EEITK (SEQ ID NO: 10)-resin column. After washing the column extensively, the phospho-APG4C-5398 antibodies were eluted and kept in antibody storage buffer.

Figure 5:
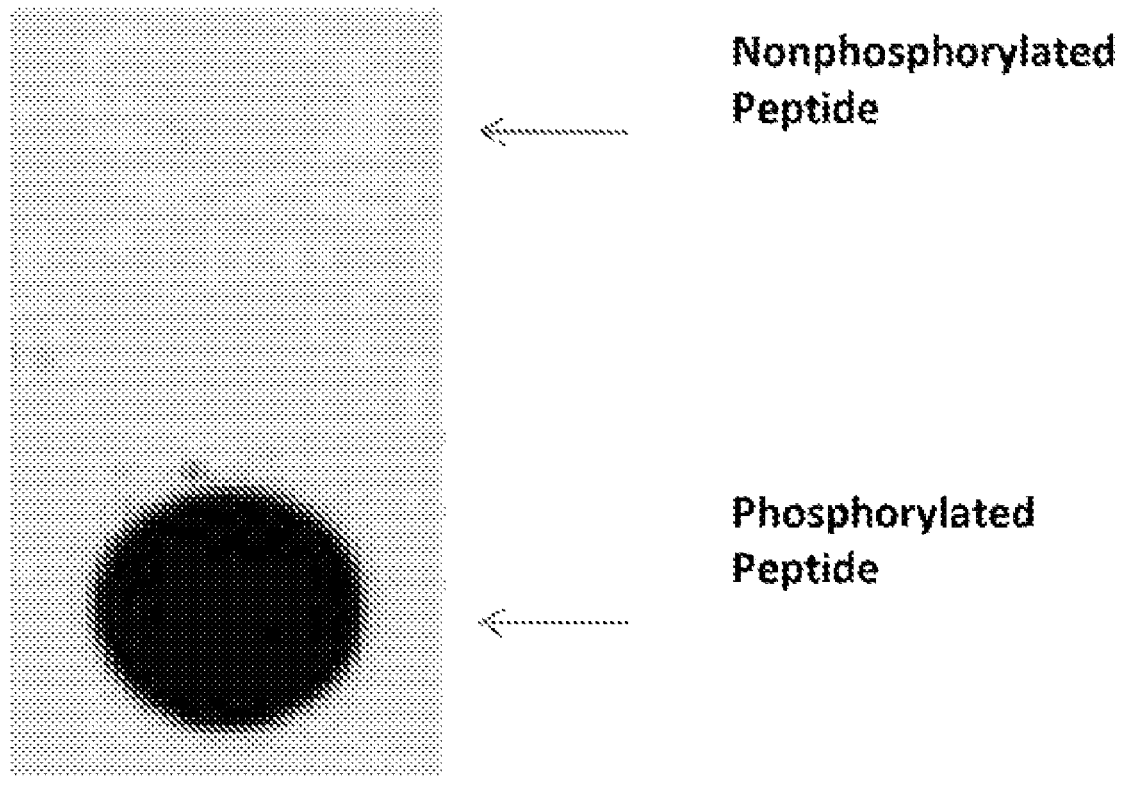
FIG. 5 shows a dot blot of an antibody that specifically binds to APG4C that is phosphorylated at serine-398.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4C-5398 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saranwrap after removing excess solution from the surface, and then exposed to X-ray film in a dark room at several different lengths of exposure. The results of the dot blot is shown in FIG. 5. As shown in this Figure, the antibody, as expected, only recognized the phosphorylated peptide. It did not recognize the non-phosphorylated peptide.

EXAMPLE 6

Production of an APG4C Serine-451 Phosphospecific Polyclonal Antibody

A 12 amino acid phospho-peptide antigen, CQLKRFS*TEEFV (SEQ ID NO: 12)(where S*=phosphoserine), corresponding to residues 446-456 of human APG4C plus cysteine on the N-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto CQLKRFSTEEFV (SEQ ID NO: 13)-resin Knotes column. The flow through fraction was collected and applied onto CQLKRFS*TEEFV (SEQ ID NO: 12)-resin column. After washing the column extensively, the phospho-APG4C-S451 antibodies were eluted and kept in antibody storage buffer.

Figure 6:
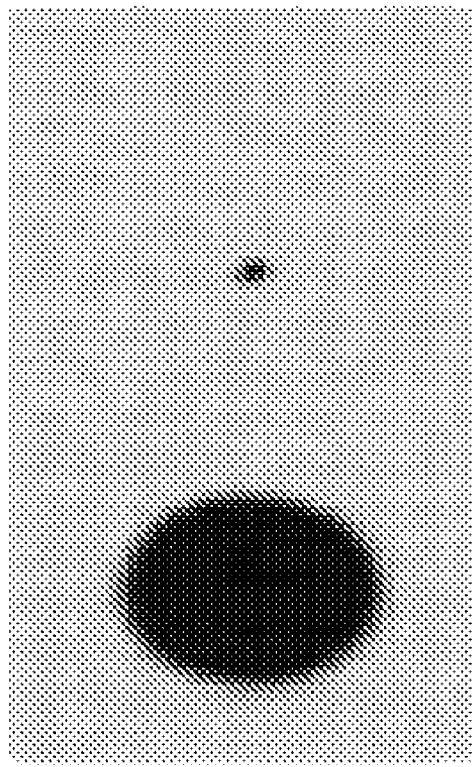
FIG. 6 shows a dot blot of an antibody that specifically binds to APG4C that is phosphorylated at serine-451.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4C-5451 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saranwrap after removing excess solution from the surface, and then exposed to X-ray film in a dark room at several different lengths of exposure. The results of the dot blot is shown in FIG. 6. As shown in this Figure, the antibody, as expected, only recognized the phosphorylated peptide. It did not recognize the non-phosphorylated peptide.

EXAMPLE 7

Production of an APG4D Serine-15 Phosphospecific Polyclonal Antibody

A 12 amino acid phospho-peptide antigen, QYRSSS*PEDARC (SEQ ID NO: 14)(where S*=phosphoserine), corresponding to residues 10-20 of human APG4D (SEQ ID NO:196) plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto QYRSSSPEDARC (SEQ ID NO: 15)-resin Knotes column. The flow through fraction was collected and applied onto QYRSSS*PEDARC (SEQ ID NO: 14)-resin column. After washing the column extensively, the phospho-APG4D-S15 antibodies were eluted and kept in antibody storage buffer.

Figure 7:
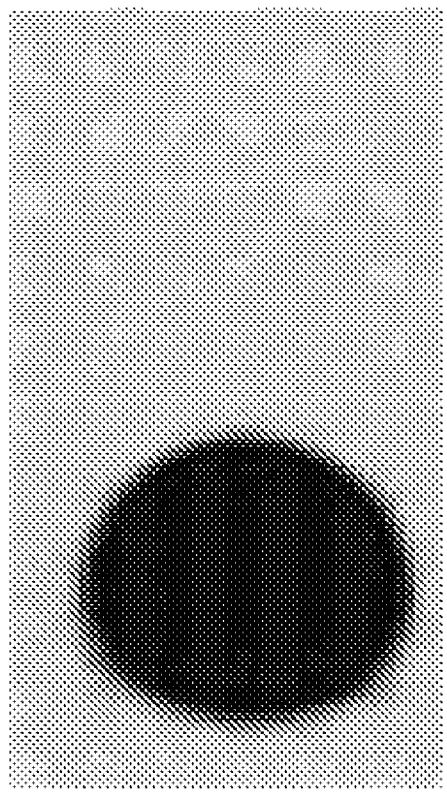
FIG. 7 shows a dot blot of an antibody that specifically binds to APG4D that is phosphorylated at serine-15.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4D-S15 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saranwrap after removing excess solution from the surface, and then exposed to X-ray film in a dark room at several different lengths of exposure. The results of the dot blot is shown in FIG. 7. As shown in this Figure, the antibody, as expected, only recognized the phosphorylated peptide. It did not recognize the non-phosphorylated peptide.

EXAMPLE 8

Production of an APG4D Serine-341 Phosphospecific Polyclonal Antibody

A 12 amino acid phospho-peptide antigen, CGKPRHS*LYFIG (SEQ ID NO: 16)(where S*=phosphoserine), corresponding to residues 336-346 of human APG4D plus cysteine on the N-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto CGKPRHSLYFIG (SEQ ID NO: 17)-resin Knotes column. The flow through fraction was collected and applied onto CGKPRHS*LYFIG (SEQ ID NO: 16)-resin column. After washing the column extensively, the phospho-APG4D-5341 antibodies were eluted and kept in antibody storage buffer.

Figure 8:
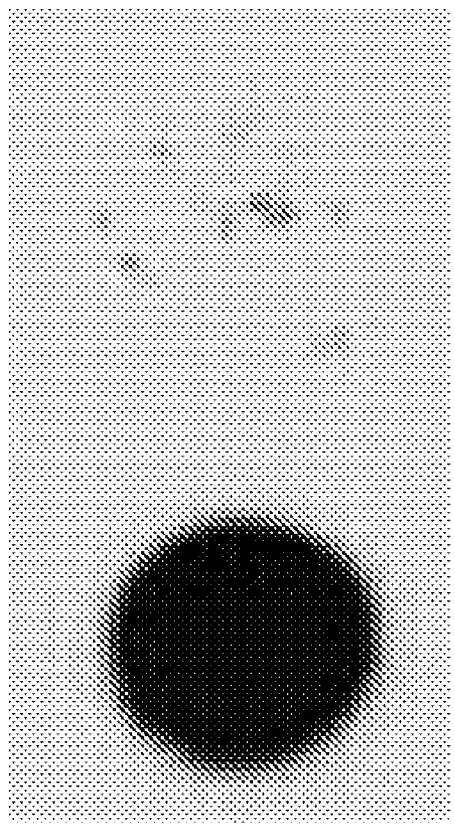
FIG. 8 shows a dot blot of an antibody that specifically binds to APG4D that is phosphorylated at serine-341.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4D-5341 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 8. As shown in this Figure, the antibody, as expected, only recognized the phosphorylated peptide. It did not recognize the non-phosphorylated peptide.

EXAMPLE 9

Production of an APG4D Serine-467 Phosphospecific Polyclonal Antibody

A 12 amino acid phospho-peptide antigen, CRAKRPS*SEDFV (SEQ ID NO: 18)(where S*=phosphoserine), corresponding to residues 462-472 of human APG4D plus cysteine on the N-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto CRAKRPSSEDFV (SEQ ID NO: 19)-resin Knotes column. The flow through fraction was collected and applied onto CRAKRPS*SEDFV (SEQ ID NO: 18)-resin column. After washing the column extensively, the phospho-APG4D-5467 antibodies were eluted and kept in antibody storage buffer.

Figure 9:
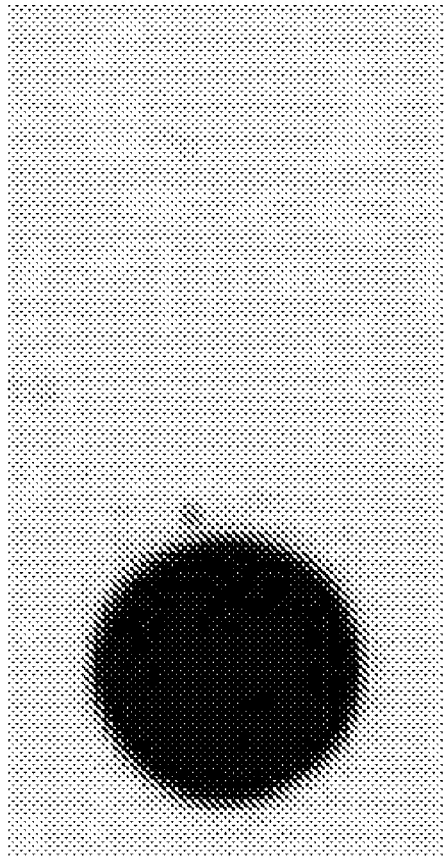
FIG. 9 shows a dot blot of an antibody that specifically binds to APG4D that is phosphorylated at serine-467.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG4D-S467 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 9. As shown in this Figure, the antibody, as expected, only recognized the phosphorylated peptide. It did not recognize the non-phosphorylated peptide.

EXAMPLE 10

Production of an APG7L Serine-95 Phosphospecific Polyclonal Antibody

A 12 amino acid phospho-peptide antigen, TNTLES*FKTADC (SEQ ID NO: 20)(where S*=phosphoserine), corresponding to residues 90-100 of human APG7L plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto TNTLESFK-TADC (SEQ ID NO: 21)-resin Knotes column. The flow through fraction was collected and applied onto TNTLES*FKTADC (SEQ ID NO: 20)-resin column. After washing the column extensively, the phospho-APG7-S95 antibodies were eluted and kept in antibody storage buffer.

Figure 10:
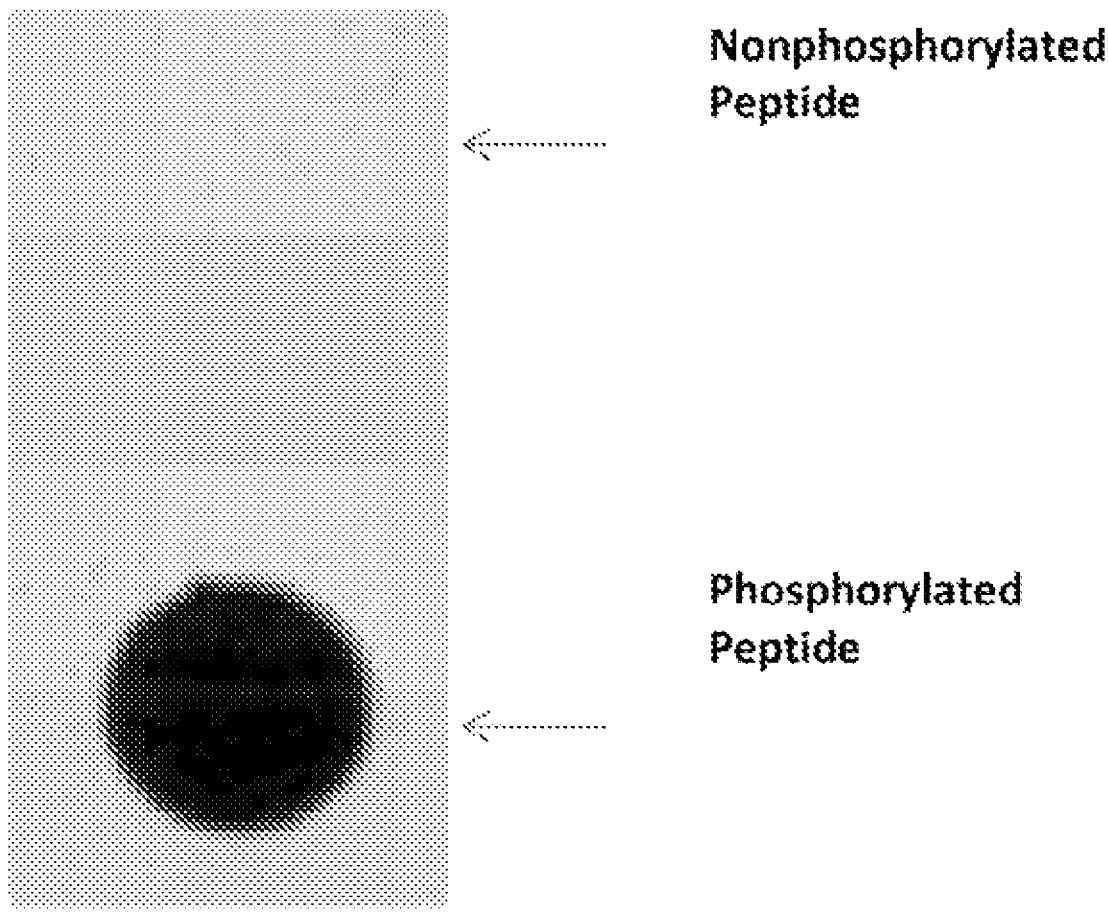
FIG. 10 shows a dot blot of an antibody that specifically binds to APG7L that is phosphorylated at serine-95.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG7-S95 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 10. As shown in this Figure, the antibody, as expected, only recognized the phosphorylated peptide. It did not recognize the non-phosphorylated peptide.

EXAMPLE 11

Production of an APG9L1 Serine-735 Phosphospecific Polyclonal Antibody

A 12 amino acid phospho-peptide antigen, WHRRES*DESGEC (SEQ ID NO: 22)(where S*=phosphoserine), corresponding to residues 730-740 of human APG9L1 plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto WHRRESDESGEC (SEQ ID NO: 23)-resin Knotes column. The flow through fraction was collected and applied onto WHRRES*DESGEC (SEQ ID NO: 22)-resin column. After washing the column extensively, the phospho-APG9L1-S735 antibodies were eluted and kept in antibody storage buffer.

Figure 11:
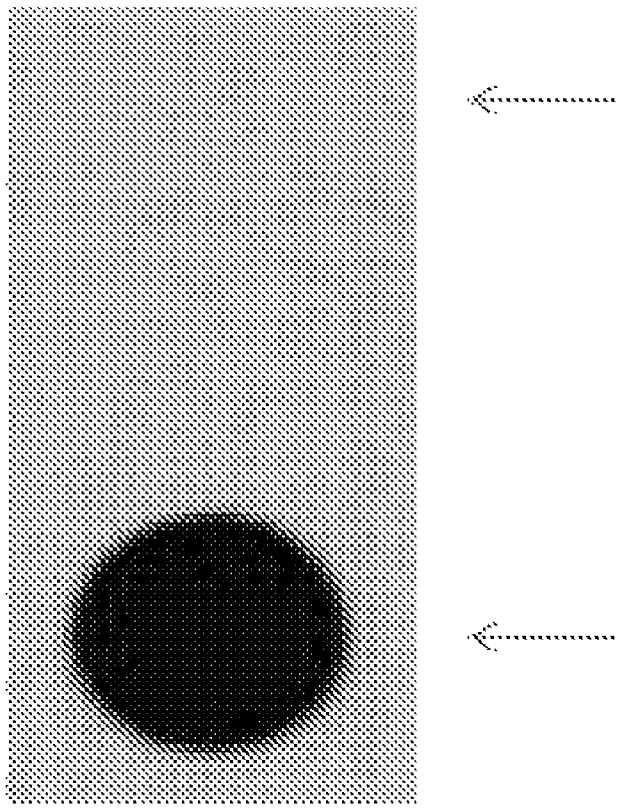
FIG. 11 shows a dot blot of an antibody that specifically binds to APG9L1 that is phosphorylated at serine-735.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG9L1-S735 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 11. As shown in this Figure, the antibody, as expected, only recognized the phosphorylated peptide. It did not recognize the non-phosphorylated peptide.

EXAMPLE 12

Production of an APG16L Serine-213 Phosphospecific Polyclonal Antibody

A 12 amino acid phospho-peptide antigen, CENEKDS*RRRQA (SEQ ID NO: 24)(where S*=phosphoserine), corresponding to residues 208-218 of human APG16L plus cysteine on the N-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 µg antigen per rabbit). The rabbits were boosted with same antigen in incomplete Freund adjuvant (100 µg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto CENEKDSRRRQA (SEQ ID NO: 25)-resin Knotes column. The flow through fraction was collected and applied onto CENEKDS*RRRQA (SEQ ID NO: 24)-resin column. After washing the column extensively, the phospho-APG16L-5213 antibodies were eluted and kept in antibody storage buffer.

Figure 12:
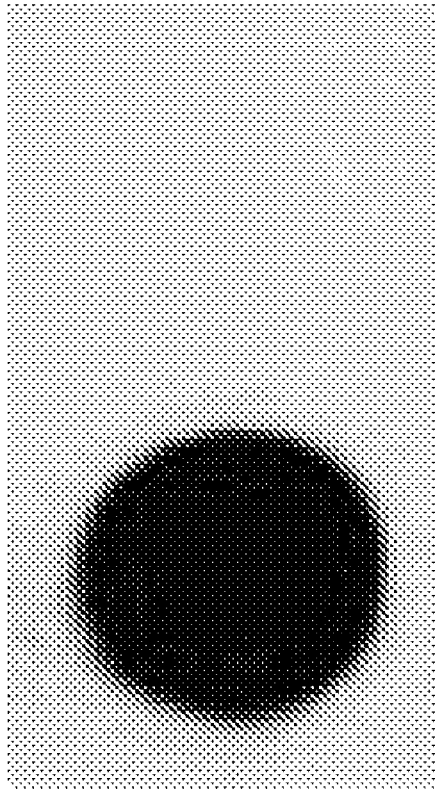
FIG. 12 shows a dot blot of an antibody that specifically binds to APG16L that is phosphorylated at serine-213.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG16L-5213 phosphospecific polyclonal antibody at a concentration of 0.5 µg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 12. As shown in this Figure, the antibody, as expected, only recognized the phosphorylated peptide. It did not recognize the non-phosphorylated peptide.

EXAMPLE 13

Production of an APG16L Serine-287 Phosphospecific Polyclonal Antibody

A 12 amino acid phospho-peptide antigen, IFGRRS*VSSFPC (SEQ ID NO: 26)(where S*=phosphoserine), corresponding to residues 282-292 of human APG16L plus cysteine on the C-terminal for coupling, was constructed according to standard synthesis techniques using a Rainin/Protein Technologies, Inc., Symphony peptide synthesizer. See, e.g., *Antibodies: A Laboratory Manual*, Chapter 5, pages 75-76, Harlow & Lane Eds., Cold Spring Harbor Laboratory (1988); Czernik, *Methods In Enzymology* (1991) 201:264-283; Merrifield, *J. Am. Chem. Soc.* (1962) 85:21-49.

This peptide was coupled to KLH, and rabbits were injected intradermally (ID) on the back with antigen in complete Freunds adjuvant (200 μg antigen per rabbit). The rabbits were boosted with same antigen in incomplete Freund adjuvant (100 μg antigen per rabbit) weekly for eight. Coincident with the dates of the third through eighth boosts, 15-20 mL bleed per rabbit was collected. One week after the eight boost, a terminating bleed of 40-60 mL per rabbit was collected. The sera were purified by Protein A-affinity chromatography as previously described (see *Antibodies: A Laboratory Manual*, Cold Spring Harbor, supra.). The eluted immunoglobulins were further loaded onto IFGRRSVSS-FPC (SEQ ID NO: 27)-resin Knotes column. The flow through fraction was collected and applied onto IFGRRS*VSSFPC (SEQ ID NO: 26)-resin column. After washing the column extensively, the phospho-APG16L-5287 antibodies were eluted and kept in antibody storage buffer.

Figure 13:
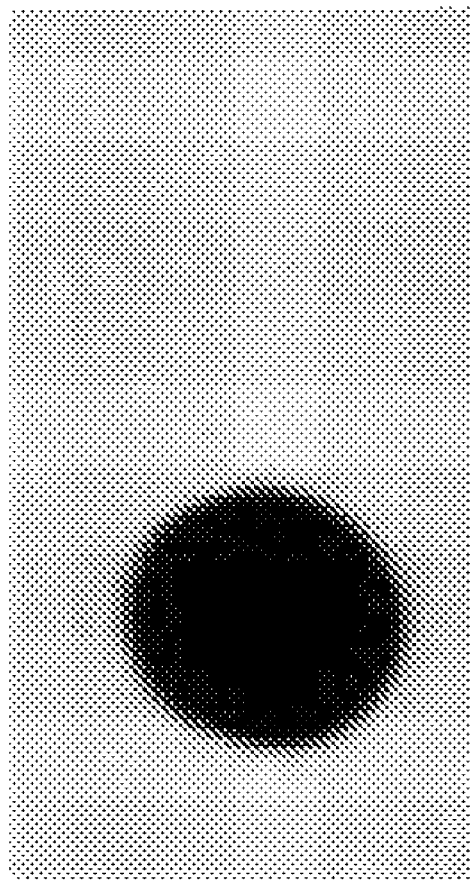
FIG. 13 shows a dot blot of an antibody that specifically binds to APG16L that is phosphorylated at serine-287.

The antibody was confirmed for phosphospecificity against the peptide antigen using Dot blot assay. 50 ng of phosphopeptide and 50 ng of the nonphosphorylated version of the peptide were spotted separately onto a nitrocellulose membrane. The membrane was allowed to dry. Non-specific sites were blocked by soaking in 5% BSA in TBS-T (0.5-1 hr, RT). A 10 cm petri dish was used for the reaction chamber. The membrane was incubated with the purified APG16L-5287 phosphospecific polyclonal antibody at a concentration of 0.5 μg/mL dissolved in BSA/TBS-T for 30 min at room temperature. The membrane was washed three times with TBS-T (3×5 min). The membrane was incubated with secondary antibody conjugated to HRP using manufacturer's recommended dilution for 30 min at room temperature. The membrane was then washed three times with TBS-T (15 min×1, 5 min×2), then once with TBS (5 min). The membrane was then incubated with ECL reagent for 1 min, covered with Saran-wrap after removing excess solution from the surface, and then exposed to X-ray film in a dark room at several different lengths of exposure. The results of the dot blot is shown in FIG. 13. As shown in this Figure, the antibody, as expected, only recognized the phosphorylated peptide. It did not recognize the non-phosphorylated peptide.

The following are further exemplary embodiments:

1. An isolated autophagy peptide comprising an amino acid sequence selected from the group consisting of sequences set forth in Table 1, wherein the x residue is nonphosphorylated or phosphorylated serine, threonine, or tyrosine, and with the proviso that the peptide is not a full-length autophagy protein.
2. An isolated autophagy peptide of embodiment 1 wherein the peptide does not comprise a sequence set forth in Table 2.
3. The isolated autophagy peptide of embodiment 1, which comprises an amino acid sequence selected from the group consisting of the sequences set forth in Table 3.
4. The isolated autophagy peptide of embodiment 1, which comprises an amino acid sequence selected from the group consisting of sequences set forth in Table 1.
5. The isolated autophagy peptide of embodiment 4, wherein the x residue is nonphosphorylated or phosphorylated serine, threonine, or tyrosine.
6. The isolated autophagy peptide of embodiment 1, wherein the x residue is phosphorylated serine, threonine, or tyrosine.
7. A pharmaceutical composition, which comprises an isolated autophagy peptide of embodiment 1 and a pharmaceutically acceptable carrier and excipient.
8. The isolated autophagy peptide of embodiment 1, which is conjugated to a carrier to enhance the peptide's immunogenicity.
9. The isolated autophagy peptide of embodiment 8, wherein the carrier is a carrier protein.
10. The isolated autophagy peptide of embodiment 9, wherein the autophagy peptide and the carrier protein are parts of a fusion protein.
11. An immunogen, which immunogen comprises:
(a) an isolated autophagy peptide of embodiment 1; and
(b) an immune response potentiator.
12. The immunogen of embodiment 11, wherein the immune response potentiator is selected from the group consisting of Bacille Calmette-Guerin (BCG), *Corynebacterium Parvum, Brucella abortus* extract, glucan, levamisole, tilorone, an enzyme and a non-virulent virus.
13. A multiple antigenic peptide (MAP), which MAP comprises a branched oligolysine core conjugated with a plurality of an isolated autophagy peptide of embodiment 1.
14. The MAP of embodiment 13, wherein the branched oligolysine core comprises 3, 7 or 15 lysine residues.
15. The MAP of embodiment 13, wherein the plurality of the autophagy peptide is conjugated to the branched oligolysine core via a spacer.
16. The MAP of embodiment 13, wherein the spacer is one or more amino acid residues.
17. The MAP of embodiment 13, which comprises 4, 8 or 16 copies of the autophagy peptide.
18. The MAP of embodiment 13, wherein the plurality of the autophagy peptide comprises same or different peptides.
19. A method for producing an antibody to an autophagy polypeptide, which method comprises:
(a) introducing an isolated autophagy peptide of embodiment 1 to a mammal in an amount sufficient to produce an antibody to said autophagy peptide; and
(b) recovering said antibody from said mammal.
20. The method of embodiment 19, wherein the x residue in the isolated autophagy peptide is nonphosphorylated serine, threonine, or tyrosine and the method is used to produce an antibody to a nonphosphorylated autophagy polypeptide.
21. The method of embodiment 19, wherein the x residue in the isolated autophagy peptide is phosphorylated serine, threonine, or tyrosine and the method is used to produce an antibody to a phosphorylated autophagy polypeptide.
22. The method of embodiment 21, which further comprises a step of removing an antibody that binds to an isolated autophagy peptide of embodiment 1 wherein x is nonphosphorylated serine, threonine, or tyrosine.
23. The method of embodiment 19, wherein the isolated autophagy peptide is conjugated to a carrier to enhance the peptide's immunogenicity.
24. The method of embodiment 19, wherein the isolated autophagy peptide is comprised in an immunogen of embodiment 10 or a MAP of embodiment 12.
25. An antibody to an autophagy polypeptide produced by the method of embodiment 19.
26. A kit for producing an antibody to an autophagy polypeptide, which kit comprises:
(a) an isolated autophagy peptide of embodiment 1;
(b) means for introducing said isolated autophagy peptide to a mammal in an amount sufficient to produce an antibody to said autophagy peptide; and
(c) means for recovering said antibody from said mammal.

27. A method for producing an antibody to an autophagy polypeptide, which method comprises:
(a) introducing an autophagy polypeptide to a mammal in an amount sufficient to produce an antibody to said autophagy polypeptide;
(b) recovering said antibody from said mammal; and
(c) affinity purifying an autophagy antibody that specifically binds to an epitope comprised in an autophagy peptide of embodiment 1 using said autophagy peptide.

28. The method of embodiment 27, wherein the autophagy polypeptide comprises a full-length autophagy protein.

29. The method of embodiments 27 and 28, wherein the x residue of the autophagy polypeptide is nonphosphorylated serine, threonine, or tyrosine and the method is used to produce an antibody to a nonphosphorylated autophagy polypeptide.

30. The method of embodiments 27 and 28, wherein the autophagy polypeptide is an autophagy polypeptide comprising a sequence set forth in Table 4, the x residue in any sequence set forth in Table 4 is phosphorylated serine, threonine, or tyrosine, and the method is used to produce an antibody to a phosphorylated autophagy polypeptide.

31. The method of embodiment 30, which further comprises a step of removing an antibody that binds to an isolated autophagy peptide of embodiment 1 wherein the x residue is nonphosphorylated serine, threonine, or tyrosine.

32. An antibody to an autophagy polypeptide produced by the method of embodiment 26.

33. A kit for producing an antibody to an autophagy polypeptide, which kit comprises:
(a) an autophagy protein;
(b) means for introducing said an autophagy protein to a mammal in an amount sufficient to produce an antibody to said autophagy polypeptide;
(c) means for recovering said antibody from said mammal; and
(d) an isolated autophagy peptide of embodiment 1.

34. An isolated antibody that specifically binds to an epitope that comprises the amino acid residue x in an amino acid sequence set forth in Table 4, wherein x is serine, threonine, tyrosine, phosphoserine, phosphothreonine or phosphotyrosine.

35. The isolated antibody of embodiment 34, wherein the epitope comprises the amino acid residue x in the amino acid sequence set forth in Table 4 and an amino acid residue of an autophagy protein that is outside the amino acid sequence set forth in Table 4.

36. The isolated antibody of embodiment 34, wherein the epitope comprises the amino acid residue x in an amino acid sequence set forth in Table 4 and amino acid residues of an autophagy protein that are outside the amino acid sequence set forth in Table 4.

37. The isolated antibody of embodiment 34, wherein the epitope is comprised in an amino acid sequence set forth in Table 4.

38. The isolated antibody of embodiment 34, wherein the epitope is comprised of an amino acid sequence set forth in Table 3.

39. The isolated antibody of embodiment 34, wherein the epitope is comprised in an amino acid sequence set forth in Table 1.

40. The isolated antibody of embodiment 34, which specifically binds to the epitope that comprises the x residue in the amino acid sequence set forth in Table 4, wherein the x residue is nonphosphorylated serine, threonine, or tyrosine.

41. The isolated antibody of embodiment 34, which specifically binds to the epitope that comprises the x residue in the amino acid sequence set forth in Table 4, wherein the x residue is phosphorylated serine, threonine, or tyrosine.

42. The isolated antibody of embodiment 34, which specifically binds to an epitope comprised in the amino acid sequence set forth in Table 4, wherein the x residue is nonphosphorylated serine, threonine, or tyrosine, but does not specifically bind to an epitope comprised in the amino acid sequence set forth in Table 4, wherein the x residue is phosphorylated serine, threonine, or tyrosine.

43. The isolated antibody of embodiment 34, which specifically binds to an epitope comprised in the amino acid sequence set forth in Table 4, wherein the x residue is phosphorylated serine, threonine, or tyrosine, but does not specifically bind to an epitope comprised in the amino acid sequence set forth in Table 4, wherein the x residue is nonphosphorylated serine, threonine, or tyrosine.

44. The isolated antibody of embodiment 43, wherein the amino acid sequence set forth in Table 4 is comprised in an autophagy protein or fragment.

45. The isolated antibody of embodiment 44, wherein the amino acid sequence set forth in Table 4 is comprised in a full length autophagy protein and the isolated antibody specifically binds to the full length autophagy protein.

46. The isolated antibody of embodiment 45, which specifically binds to the full length autophagy protein when the x residue is nonphosphorylated serine, threonine, or tyrosine in the amino acid sequence set forth in Table 4 but does not specifically bind to the full length autophagy protein when the x residue is phosphorylated serine, threonine, or tyrosine in the amino acid sequence set forth in Table 4.

47. The isolated antibody of embodiment 45, which specifically binds to the full length autophagy protein when the x residue is phosphorylated serine, threonine, or tyrosine in the amino acid sequence set forth in Table 4 but does not specifically bind to the full length autophagy protein when the x residue is nonphosphorylated serine, threonine, or tyrosine in the amino acid sequence set forth in Table 4.

48. The isolated antibody of embodiment 45, which specifically binds to the full length autophagy protein at its natural conformation.

49. The isolated antibody of embodiment 34, which is a monoclonal or polyclonal antibody or an antibody fragment.

50. A method for detecting an autophagy protein or fragment comprising an amino acid sequence set forth in Table 4, wherein the x residue is phosphorylated or nonphosphorylated serine, threonine, or tyrosine in a sample, which method comprises:
(a) contacting a sample containing or suspected of containing an autophagy protein or fragment comprising the amino acid sequence set forth in Table 4, wherein the x residue is phosphorylated or nonphosphorylated serine, threonine, or tyrosine, with an isolated antibody that specifically binds to an epitope that comprises the amino acid residue x in the amino acid sequence set forth in Table 4, wherein the x residue is phosphorylated or nonphosphorylated serine, threonine, or tyrosine; and (b) assessing a complex formed between said autophagy protein or fragment, if present in said sample, and said antibody, to determine the presence, absence and/or amount of said autophagy protein or fragment in said sample.

51. The method of embodiment 50, wherein the epitope comprises the amino acid residue x in the amino acid sequence set forth in Table 4 and an amino acid residue of the autophagy protein that is outside the amino acid sequence set forth in Table 4.

52. The method of embodiment 50, wherein the epitope comprises the amino acid residue x in the amino acid sequence set forth in Table 4 and amino acid residues of the autophagy protein that are outside the amino acid sequence set forth in Table 4.

53. The method of embodiment 50, wherein the epitope is comprised in the amino acid sequence set forth in Table 4.

54. The method of embodiment 50, wherein the epitope is comprised in an amino acid sequence set forth in Table 3.

55. The method of embodiment 50, wherein the epitope is comprised in an amino acid sequence selected from the sequence set forth in Table 1.

56. The method of embodiment 50, wherein the isolated antibody specifically binds to the epitope that comprises the x residue in the amino acid sequence set forth in Table 4, wherein the x residue is nonphosphorylated serine, threonine, or tyrosine.

57. The method of embodiment 50, wherein the isolated antibody specifically binds to the epitope that comprises the x residue in the amino acid sequence set forth in Table 4, wherein the x residue is phosphorylated serine, threonine, or tyrosine.

58. The method of embodiment 50, wherein the isolated antibody specifically binds to an epitope comprised in the amino acid sequence set forth in Table 4, wherein the x residue is nonphosphorylated serine, threonine, or tyrosine, but does not specifically bind to an epitope comprised in the amino acid sequence set forth in Table 4, wherein the x residue is phosphorylated serine, threonine, or tyrosine.

59. The method of embodiment 50, wherein the isolated antibody specifically binds to an epitope comprised in the amino acid sequence set forth in Table 4, wherein the x residue is phosphorylated serine, threonine, or tyrosine, but does not specifically bind to an epitope comprised in the amino acid sequence set forth in Table 4, wherein the x residue is nonphosphorylated serine, threonine, or tyrosine.

60. The method of embodiment 50, wherein the amino acid sequence set forth in Table 4 is comprised in a full length autophagy protein and the isolated antibody specifically binds to the full length autophagy protein.

61. The method of embodiment 60, wherein the isolated antibody specifically binds to the full length autophagy protein when the x residue is nonphosphorylated serine, threonine, or tyrosine in the amino acid sequence set forth in Table 4 but does not specifically bind to the full length autophagy protein when the x residue is phosphorylated serine, threonine, or tyrosine in the amino acid sequence set forth in Table 4 to determine the presence, absence and/or amount of nonphosphorylated full length autophagy protein in the sample.

62. The method of embodiment 60, wherein the isolated antibody specifically binds to the full length autophagy protein when the x residue is phosphorylated serine, threonine, or tyrosine in the amino acid sequence set forth in Table 4 but does not specifically bind to the full length autophagy protein when the x residue is nonphosphorylated serine, threonine, or tyrosine in the amino acid sequence set forth in Table 4 to determine the presence, absence and/or amount of phosphorylated full length autophagy protein in the sample.

63. The method of embodiment 50, wherein the isolated antibody specifically binds to the full length autophagy protein at its natural conformation.

64. The method of embodiment 50, wherein the isolated antibody is a monoclonal or polyclonal antibody or antibody fragment.

65. The method of embodiment 50, wherein the complex is assessed by a sandwich or competitive assay format.

66. The method of embodiment 65, wherein the antibody that that specifically binds to an epitope that comprises the amino acid residue x in the amino acid sequence set forth in Table 4 is used as a first antibody and an antibody that is capable of binding to a portion of an autophagy protein or fragment other than the portion that binds to the first antibody is used as a second antibody in a sandwich assay format.

67. The method of embodiment 66, wherein either the first antibody or the second antibody is attached to a surface and functions as a capture antibody.

68. The method of embodiment 67, wherein the capture antibody is attached to the surface directly or indirectly.

69. The method of embodiment 67, wherein the capture antibody is attached to the surface via a biotin-avidin (or streptavidin) linking pair.

70. The method of embodiment 50, wherein the complex is assessed by a format selected from the group consisting of an enzyme-linked immunosorbent assay (ELISA), immunoblotting, immunoprecipitation, radioimmunoassay (RIA), immuno staining, latex agglutination, indirect hemagglutination assay (IHA), complement fixation, indirect immunofluorescent assay (IFA), nephelometry, flow cytometry assay, plasmon resonance assay, chemiluminescence assay, lateral flow immunoassay, u-capture assay, inhibition assay and avidity assay.

71. The method of embodiment 50, wherein the complex is assessed in a homogeneous or a heterogeneous assay format.

72. The method of embodiment 50, which is used to determine the phosphorylation status of an autophagy protein or fragment comprising the amino acid sequence set forth in Table 4.

73. The method of embodiment 72, which is used to determine the phosphorylation status of a full length autophagy protein.

74. The method of embodiment 73, which is used to determine the phosphorylation status of a full length autophagy protein in a biological sample.

75. The method of embodiment 74, wherein the biological sample is a clinical sample.

76. The method of embodiment 74, which is used for the prognosis, diagnosis and/or treatment monitoring of a disease or disorder associated with abnormal phosphorylation status of an autophagy polypeptide comprising the amino acid sequence set forth in Table 4.

77. The method of embodiment 76, wherein the autophagy protein is a full length autophagy protein.

78. The method of embodiment 76, wherein the disease or disorder associated with abnormal phosphorylation status of an autophagy protein or fragment is selected from the group consisting of ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.

79. A kit for detecting an autophagy protein or fragment comprising amino acid sequence set forth in Table 4, wherein the x residue is phosphorylated or nonphosphorylated serine, threonine, or tyrosine, in a sample, which kit comprises, in a container, an isolated antibody that specifically binds to an epitope that comprises the x residue in the amino acid sequence set forth in Table 4, wherein the x residue is phosphorylated or nonphosphorylated serine, threonine, or tyrosine.

80. A method for treating a disease or disorder associated with abnormal phosphorylation status of an autophagy protein or fragment comprising amino acid sequence set forth in Table 4, wherein the x residue is phosphorylated or nonphosphorylated serine, threonine, or tyrosine, which method comprises administering, to a subject when such a treatment is needed or desired, a sufficient amount of an isolated antibody that specifically binds to an epitope that comprises the amino acid residue x in the amino acid sequence set forth in Table 4, wherein the x residue is phosphorylated or nonphosphorylated serine, threonine, or tyrosine.

81. The method of embodiment 80, wherein the isolated antibody specifically binds to an epitope comprised in the amino acid sequence set forth in Table 4, wherein x residue is nonphosphorylated serine, threonine, or tyrosine, but does not specifically bind to an epitope comprised in the amino acid sequence set forth in Table 4, wherein the x residue is phosphorylated serine, threonine, or tyrosine.

82. The method of embodiment 81, wherein the disease or disorder is associated with abnormally high phosphorylation level of an autophagy protein or fragment, and the binding of the antibody to the autophagy protein or fragment prevents or reduces phosphorylation level of the autophagy protein or fragment.

84. The method of embodiment 80, wherein the isolated antibody specifically binds to an epitope comprised in the amino acid sequence set forth in Table 4, wherein the x residue is phosphorylated serine, threonine, or tyrosine, but does not specifically bind to an epitope comprised in the amino acid sequence set forth in Table 4, wherein the x residue is nonphosphorylated serine, threonine, or tyrosine.

85. The method of embodiment 84, wherein the disease or disorder is associated with abnormally low phosphorylation level of an autophagy protein or fragment, and the binding of the antibody to the autophagy protein or fragment prevents or reduces dephosphorylation of the autophagy protein or fragment.

86. The method of embodiments 82 and 85, wherein the disease or disorder associated with abnormally low phosphorylation level of an autophagy protein is selected from the group consisting of ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens 87. The method of embodiment 80, wherein the amino acid sequence set forth in Table 4 is comprised in a full length autophagy protein and the isolated antibody specifically binds to the full length autophagy protein.

88. The method of embodiment 87, wherein the isolated antibody specifically binds to the full length autophagy protein when the x residue is nonphosphorylated serine, threonine, or tyrosine in the amino acid sequence set forth in Table 4 but does not specifically bind to the full length autophagy protein when the x residue is phosphorylated serine, threonine, or tyrosine in the amino acid sequence set forth in Table 4.

89. The method of embodiment 87, wherein the isolated antibody specifically binds to the full length autophagy protein when the x is phosphorylated serine, threonine, or tyrosine in the amino acid sequence set forth in Table 4 but does not specifically bind to the full length autophagy protein when the x residue is nonphosphorylated serine, threonine, or tyrosine in the amino acid sequence set forth in Table 4.

90. The method of embodiment 80, wherein the isolated antibody specifically binds to the full length autophagy protein at its natural conformation.

91. The method of embodiment 80, wherein the isolated antibody is a monoclonal or polyclonal antibody or antibody fragment.

92. The method of embodiment 80, which further comprises administering a pharmaceutically acceptable carrier and excipient.

93. The method of embodiment 80, wherein the subject is a mammal.

94. The method of embodiment 93, wherein the mammal is a human.

95. A pharmaceutical composition, which comprises an isolated antibody of embodiment 80 and a pharmaceutically acceptable carrier and excipient.

96. A method for identifying a kinase that phosphorylates an autophagy protein on the nonphosphorylated serine, threonine, or tyrosine at the x residue, which method comprises:
(a) providing an autophagy polypeptide comprising an amino acid sequence selected from a sequence set forth in Table 1, wherein the x residue is nonphosphorylated serine, threonine, or tyrosine;
(b) contacting said autophagy polypeptide with a test protein and ATP under conditions suitable for the phosphorylation of said x residue of said autophagy polypeptide; and
(c) assessing phosphorylation status of said autophagy polypeptide to determine whether said test protein is a kinase for said autophagy protein on the nonphosphorylated serine, threonine, or tyrosine at the x residue.
97. The method of embodiment 96, wherein the autophagy protein or fragment comprises an amino acid sequence set forth in Table 4 wherein the x residue is nonphosphorylated serine, threonine, or tyrosine.
98. The method of embodiment 96, wherein the phosphorylation status of the autophagy polypeptide is assessed by an isolated antibody that specifically binds to an epitope comprised in the amino acid sequence set forth in Table 4, wherein the x residue is phosphorylated serine, threonine, or tyrosine, but does not specifically bind to an epitope comprised in the amino acid sequence set forth in Table 4, wherein the x residue is nonphosphorylated serine, threonine, or tyrosine.
99. A method for identifying a modulator of a kinase that phosphorylates an autophagy protein on the x residue, which method comprises:
(a) providing an autophagy polypeptide comprising an amino acid sequence in set forth in Table 1, wherein the x residue is nonphosphorylated serine, threonine, or tyrosine;
(b) contacting said autophagy polypeptide with a kinase that phosphorylates an autophagy protein on the nonphosphorylated x residue of serine, threonine, or tyrosine and ATP under conditions suitable for the phosphorylation of said x residue of said autophagy polypeptide in the presence or absence of a test substance; and
(c) assessing and comparing phosphorylation status of said autophagy polypeptide by said kinase to determine whether said test substance modulates said kinase.
100. The method of embodiment 99, wherein the autophagy protein or fragment comprises an amino acid sequence set forth in Table 4 wherein the x residue is nonphosphorylated serine, threonine, or tyrosine.
101. The method of embodiment 99, wherein the phosphorylation status of the autophagy polypeptide is assessed by an isolated antibody that specifically binds to an epitope comprised in the amino acid sequence set forth in Table 4, wherein x is phosphoserine, but does not specifically bind to an epitope comprised in the amino acid sequence set forth in Table 4, wherein the x residue is nonphosphorylated serine, threonine, or tyrosine.
102. A method for identifying a phosphatase that dephosphorylates an autophagy protein on the phosphorylated x residue of serine, threonine, or tyrosine, which method comprises:
(a) providing an autophagy polypeptide comprising an amino acid sequence set forth in Table 1, wherein the x residue is phosphorylated serine, threonine, or tyrosine;
(b) contacting said autophagy polypeptide with a test protein and H$_2$O under conditions suitable for the dephosphorylation of said x residue of said autophagy polypeptide; and
(c) assessing phosphorylation status of said autophagy polypeptide to determine whether said test protein is a phosphatase for said autophagy protein on the phosphorylated x residue of serine, threonine, or tyrosine.
103. The method of embodiment 102, wherein the autophagy protein or fragment comprises an amino acid sequence set forth in Table 4 wherein the x residue is phosphorylated serine, threonine, or tyrosine.
104. The method of embodiment 103, wherein the phosphorylation status of the autophagy polypeptide is assessed by an isolated antibody that specifically binds to an epitope comprised in the amino acid sequence set forth in Table 4, wherein the x residue is nonphosphorylated serine, threonine, or tyrosine, but does not specifically bind to an epitope comprised in the amino acid sequence set forth in Table 4, wherein the x residue is phosphorylated serine, threonine, or tyrosine.
105. A method for identifying a modulator of a phosphatase that dephosphorylates an autophagy protein on the phosphorylated x residue of serine, threonine, or tyrosine, which method comprises:
(a) providing said autophagy polypeptide comprising an amino acid sequence in set forth in Table 1, wherein the x residue is phosphorylated serine, threonine, or tyrosine;
(b) contacting said autophagy polypeptide with a phosphatase that dephosphorylates an autophagy protein on the phosphorylated x residue of serine, threonine, or tyrosine and H$_2$O under conditions suitable for the dephosphorylation of said phosphoserine residue of said autophagy polypeptide in the presence or absence of a test substance; and
(c) assessing and comparing dephosphorylation status of said autophagy polypeptide by said phosphatase to determine whether said test substance modulates said phosphatase.
106. The method of embodiment 105, wherein the autophagy protein or fragment comprises an amino acid sequence set forth in Table 4 wherein the x residue is phosphorylated serine, threonine, or tyrosine.
107. The method of embodiment 106, wherein the phosphorylation status of the autophagy polypeptide is assessed by an isolated antibody that specifically binds to an epitope comprised in the amino acid sequence set forth in Table 4, wherein x is nonphosphorylated serine, threonine, or tyrosine, but does not specifically bind to an epitope comprised in the amino acid sequence set forth in Table 4, wherein the x residue is phosphorylated serine, threonine, or tyrosine.
108. An isolated nucleic acid fragment, which isolated nucleic acid fragment comprises a sequence of nucleotides encoding an autophagy peptide comprising an amino acid sequence set forth in Table 1, wherein the x residue is nonphosphorylated serine, threonine, or tyrosine, and with the proviso that the peptide is not a full-length autophagy protein comprising an amino acid sequence set forth in Table 2.
109. The isolated nucleic acid fragment of embodiment 108, wherein the autophagy peptide comprises an amino acid sequence set forth in Table 4.
110. The isolated nucleic acid fragment of embodiment 108, wherein the nucleic acid is DNA.
111. The isolated nucleic acid fragment of embodiment 108, wherein the nucleic acid is RNA.
112. A plasmid, which plasmid comprises the nucleic acid fragment of embodiment 108.
113. A vector, which vector comprises the nucleic acid fragment of embodiment 108.
114. A cell, which cell comprises the plasmid of embodiment 112 or the vector of embodiment 113.
115. The cell of embodiment 114, which is selected from the group consisting of a bacterial cell, a yeast cell, a fungal cell, a plant cell, an insect cell, an animal cell and a human cell.
116. A method for producing an autophagy peptide, which method comprises growing the cell of embodiment 114 under conditions whereby said autophagy peptide is expressed by the cell, and recovering said expressed autophagy peptide.

117. The method of embodiment 116, further comprises a step of phosphorylating the autophagy peptide at the nonphosphorylated x residue of serine, threonine, or tyrosine.
118. A method for identifying a compound that binds specifically to a phosphorylated autophagy polypeptide, which method comprises:
a) providing a phosphorylated autophagy polypeptide comprising an amino acid sequence set forth in Table 1, wherein the x residue is phosphorylated serine, threonine, or tyrosine;
b) contacting said phosphorylated autophagy polypeptide with a test compound under conditions suitable for binding of the test protein with the autophagy polypeptide;
c) assessing binding of the phosphorylated autophagy polypeptide with the test compound;
d) providing a nonphosphorylated autophagy polypeptide comprising an amino acid sequence selected set forth in Table 1, wherein the x residue is phosphorylated serine, threonine, or tyrosine;
e) contacting said nonphosphorylated autophagy polypeptide with the test compound under conditions suitable for binding of the test protein with the autophagy polypeptide;
f) assessing binding of the nonphosphorylated autophagy polypeptide with the test compound
wherein the compound that binds specifically to a phosphorylated autophagy polypeptide is a test compound which binds to phosphorylated autophagy polypeptide according to step c) but does not bind to nonphosphorylated autophagy polypeptide according to step e).
119. A method for identifying a compound that binds to specifically to a nonphosphorylated autophagy polypeptide, which method comprises:
a) providing a nonphosphorylated autophagy polypeptide comprising an amino acid sequence set forth in Table 1, wherein the x residue is nonphosphorylated serine, threonine, or tyrosine;
b) contacting said nonphosphorylated autophagy polypeptide with a test compound under conditions suitable for binding of the test protein with autophagy polypeptide;
c) assessing binding of the nonphosphorylated autophagy polypeptide with the test compound;
d) providing a phosphorylated autophagy polypeptide comprising an amino acid sequence set forth in Table 1, wherein the x residue is phosphorylated serine, threonine, or tyrosine;
e) contacting said phosphorylated autophagy polypeptide with the test compound and under conditions suitable for binding of the test protein with autophagy polypeptide;
f) assessing binding of the phosphorylated autophagy polypeptide with the test compound
wherein the compound that binds specifically to a nonphosphorylated autophagy polypeptide is a test compound which binds to nonphosphorylated autophagy polypeptide according to step c) but does not bind to phosphorylated autophagy polypeptide according to step e).
120. The methods of embodiments 118 and 119, wherein the test compound is a protein.
121. The methods of embodiments 118 and 119, wherein the test compound is a peptide.
122. The methods of embodiments 118 and 119, wherein the test compound is a nucleic acid.
123. The methods of embodiments 118 and 119, wherein the test compound is a small molecule.
124. A method of treating a disease comprising modulating phosphorylation status of an autophagy polypeptide by administering an autophagy antibody, an autophagy peptide, or compounds from the screening process of embodiments 107 and 118-123, wherein the disease is selected from the group consisting of ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.
125. A array comprising an antibody of embodiments 25, 32, and 34-49.
126. A method of array detection comprising use of an antibody of embodiments 25, 32, and 34-39.
127. A microarray comprising a solid support and a plurality of antibodies of embodiments 25, 32, and 34-49 immobilized on the solid support at a known predetermined position.
128. A microarray comprising a solid support and a plurality of polypeptides of embodiments 1-10.
129. The use of a microarray of embodiments 127-128 for assessing the phosphorylation status of a plurality of autophagy polypeptides in the autophagy pathway.
130. A method of monitoring the phosphorylation of an autophagy polypeptide, wherein the monitoring uses a microarray of embodiments 127-128.
131. A method of treating a disease comprising modulating the phosphorylation of an autophagy polypeptide at the x residue set forth in Table 4.
132. The method of embodiment 131, wherein the disease is selected from the group consisting of ischemic brain injury, Alzheimer's disease, Parkinson's disease, amyotrophic lateral sclerosis, prion diseases and polyglutamine disorders including Huntington's disease and various spinocerebellar ataxias, transmissible spongiform encephalopathies such as Creutzfeldt-Jakob disease, breast cancer, ovarian cancer, brain cancer, pancreatic cancer, esophageal cancer, colorectal cancer, liver cancer, prostate cancer, renal cancer, lung cancer, Myocardial ischemia, cardiac remodeling, cardiomyopathy, hemodynamic stress, myocardial hypertrophy, Neuronal ceroid-lipofuscinosis (adult and juvenile), Multiple Sulfatase Deficiency (MSD) and Mucopolysaccharidosis type IIIA, Batten disease, Niemann-Pick C, Danon disease, Pompe disease, and dysfunction of innate and adaptive immunity against intracellular pathogens.
133. The method of embodiments 131 and 132, wherein phosphorylation of the autophagy polypeptide is increased.
134. The method of embodiments 131 and 132, wherein phosphorylation of the autophagy polypeptide is decreased.
135. The method of embodiments 131, 133, and 134, wherein the phosphorylation status of the autophagy polypeptide is abnormal.
136. The method of embodiments 131, 133, and 134, wherein the phosphorylation status of the autophagy polypeptide is normal and wherein the disease is treatable by modulating the phosphorylation status of the autophagy polypeptide.

TABLE 1

Epitopes that include the phosphorylation site in autophagy proteins.

| NO | Protein Name and Phosphorylation Site | X equals: | Sequence (SEQ ID NO) |
|---|---|---|---|
| 1 | APG3L-pY18 | Tyrosine or Phosphotyrosine | VAEX (28), AEXL (29), EXLT (30), XLTP (31) |
| 2 | APG3L-pY160 | Tyrosine or Phosphotyrosine | MEEX (32), EEXE (33), EXEE (34), XEES (35) |
| 3 | APG4A-pS6 | Serine or Phosphoserine | SVLX (36), VLXK (37), LXKY (38), XKYE (39) |
| 4 | APG4A-pS62 | Serine or Phosphoserine | RKFX (40), KFXP (41), FXPI (42), XPIG (43) |
| 5 | APG4A-pS100 | Serine or Phosphoserine | RDWX (44), DWXW (45), WXWE (46), XWEK (47) |
| 6 | APG4B-pS121 | Serine or Phosphoserine | RKDX (48), KDXY (49), DXYY (50), XYYS (51) |
| 7 | APG4B-pS309 | Serine or Phosphoserine | CRMX (52), RMXI (53), MXIA (54), XIAE (55) |
| 8 | APG4C-pS166 | Serine or Phosphoserine | ASLX (56), SLXG (57), LXGE (58), XGER (59) |
| 9 | APG4C-pS177 | Serine or Phosphoserine | PTIX (60), TIXL (61), IXLK (62), XLKE (63) |
| 10 | APG4C-pS224 | Serine or Phosphoserine | GKKX (64), KKXG (65), KXGK (66), XGKK (67) |
| 11 | APG4C-pS398 | Serine or Phosphoserine | KRAX (68), RAXE (69), AXEE (70), XEEI (71) |
| 12 | APG4C-S408 | Serine or Phosphoserine | LKFX (72), KFXS (73), FXSK (74), XSKE (75) |
| 13 | APG4C-pS451 | Serine or Phosphoserine | KRFX (76), RFXT (77), FXTE (78), XTEE (79) |
| 14 | APG4D-S15 | Serine or Phosphoserine | RSSX (80), SSXP (81), SXPE (82), XPED (83) |
| 15 | APG4D-pS341 | Serine or Phosphoserine | PRHX (84), RHXL (85), HXLY (86), XLYF (87) |
| 16 | APG4D-pS467 | Serine or Phosphoserine | KRPX (88), RPXS (89), PXSE (90), XSED (91) |
| 17 | APG5L-pY35 | Tyrosine or Phosphotyrosine | AEPX (92), EPXY (93), PXYL (94), XYLL (95) |
| 18 | APG5L-pS225 | Serine or Phosphoserine | VCPX (96), CPXA (97), PXAI (98), XAID (99) |
| 19 | APG7L-pS95 | Serine or Phosphoserine | TLEX (100), LEXF (101), EXFK (102), XFKT (103) |
| 20 | APG7L-pS173 | Serine or Phosphoserine | QRFX (104), RFXL (105), FXLK (106), XLKQ (107) |
| 22 | APG8b-pT12 | Threonine or Phosphothreonine | QRRX (108), RRXF (109), RXFE (110), XFEQ (111) |
| 23 | APG8b-pS101 | Serine or Phosphoserine | VYEX (112), YEXE (113), EXEK (114), XEKD (115) |
| 25 | APG8c-pS137 | Serine or Phosphoserine | RDGX (116), DGXS (117), GXSL (118), XSLE (119) |
| 26 | APG8c-pS137/138 | Serine or Phosphoserine | RDGXX (120), DGXXL (121), GXXLE (122), XXLED (123) |
| 27 | APG8c-pS138 | Serine or Phosphoserine | DGSX (124), GSXL (125), SXLE (126), XLED (127) |

TABLE 1-continued

Epitopes that include the phosphorylation site in autophagy proteins.

| NO | Protein Name and Phosphorylation Site | X equals: | Sequence (SEQ ID NO) |
|---|---|---|---|
| 28 | APG9L1-pS14 | Serine or Phosphoserine | LEAX (128), EAXY (129), AXYS (130), XYSD (131) |
| 29 | APG9L1-pY209 | Tyrosine or Phosphotyrosine | LDIX (132), DIXH (133), IXHR (134), XHRI (135) |
| 30 | APG9L1-pS613 | Serine or Phosphoserine | SLQX (136), LQXE (137), QXES (138), XESE (139) |
| 31 | APG9L1-pS735 | Serine or Phosphoserine | RREX (140), REXD (141), EXDE (142), XDES (143) |
| 32 | APG9L1-pS738 | Serine or Phosphoserine | SDEX (144), DEXG (145), EXGE (146), XGES (147) |
| 33 | APG9L1-pS741 | Serine or Phosphoserine | SGEX (148), GEXA (149), EXAP (150), XAPD (151) |
| 34 | APG9L1-pS828 | Serine or Phosphoserine | EEGX (152), EGXE (153), GXED (154), XEDE (155) |
| 35 | APG10L-pS116 | Serine or Phosphoserine | FRAX (156), RAXF (157), AXFL (158), XFLD (159) |
| 36 | APG12L-pS26 | Serine or Phosphoserine | TDVX (160), DVXP (161), VXPE (162), XPET (163) |
| 37 | APG12L-pS41 | Serine or Phosphoserine | AAVX (164), AVXP (165), VXPG (166), XPGT (167) |
| 38 | APG16L-pS213 | Serine or Phosphoserine | EKDX (168), KDXR (169), DXRR (170), XRRR (171) |
| 39 | APG16L-pS287 | Serine or Phosphoserine | GRRX (172), RRXV (173), RXVS (174), XVSS (175) |
| 40 | APG16L-pS304 | Serine or Phosphoserine | HPGX (176), PGXG (177), GXGK (178), XGKE (179) |
| 41 | BECN1-pS64 | Serine or Phosphoserine | ETNX (180), TNXG (181), NXGE (182), XGEE (183) |
| 42 | BECN1-pT72 | Threonine or Phosphothreonine | FIEX (184), IEXP (185), EXPR (186), XPRQ (187) |
| 43 | BECN1-pS249 | Serine or Phosphoserine | ELKX (188), LKXV (189), KXVE (190), XVEN (191) |

TABLE 2

Full-length sequences of autophagy proteins.

| NO | PRODUCT NAME | NCBI Accession | Sequence | SEQ ID NO |
|---|---|---|---|---|
| 1 | APG3L Y18, Y160 | NP_071933 | MQNVINTVKGKALEVAEYLTPVLKESK FKETGVITPEEFVAAGDHLVHHCPTWQ WATGEELKVKAYLPTGKQFLVTKNVP CYKRCKQMEYSDELEAIIEEDDGDGGW VDTYHNTGITGITEAVKEITLENKDNIR LQDCSALCEEEEDEDEGEAADMEEYEE SGLLETDEATLDTRKIVEACKAKTDAG GEDAILQTRTYDLYITYDKYYQTPRLW LFGYDEQRQPLTVEHMYEDISQDHVKK TVTIENHPHLPPPPMCSVHPCRHAEVM KKIIETVAEGGGELGVHMYLLIFLKFVQ AVIPTIEYDYTRHFTM | 192 |

TABLE 2-continued

Full-length sequences of autophagy proteins.

| NO | PRODUCT NAME | NCBI Accession | Sequence | SEQ ID NO |
|---|---|---|---|---|
| 2 | APG4A<br>S6, S62,<br>S100 | NP_443168 | MESVLSKYEDQITIFTDYLEEYPDTDEL<br>VWILGKQHLLKTEKSKLLSDISARLWFT<br>YRRKFSPIGGTGPSSDAGWGCMLRCGQ<br>MMLAQALICRHLGRDWSEKQKEQPK<br>EYQRILQCFLDRKDCCYSIHQMAQMGV<br>GEGKSIGEWFGPNTVAQVLKKLALFDE<br>WNSLAVYVSMDNTVVIEDIKKMCRVL<br>PLSADTAGDRPPDSLTASNQSKGTSAY<br>CSAWKPLLLIVPLRLGINQINPVYVDAF<br>KECFKMPQSLGALGGKPNNAYYFIGFL<br>GDELIFLDPHTTQTFVDTEENGTVNDQT<br>FHCLQSPQRMNILNLDPSVALGFFCKEE<br>KDFDNWCSLVQKEILKENLRMFELVQK<br>HPSHWPPFVPPAKPEVTTTGAEFIDSTE<br>QLEEFDLEEDFEILSV | 193 |
| 3 | APG4B<br>S121, S309 | NP_037457 | MDAATLTYDTLRFAEFEDFPETSEPVWI<br>LGRKYSIFTEKDEILSDVASRLWFTYRK<br>NFPAIGGTGPTSDTGWGCMLRCGQMIF<br>AQALVCRHLGRDWRWTQRKRQPDSYF<br>SVLNAFIDRKDSYYSIHQIAQMGVGEG<br>KSIGQWYGPNTVAQVLKKLAVFDTWS<br>SLAVHIAMDNTVVMEEIRRLCRTSVPC<br>AGATAFPADSDRHCNGFPAGAEVTNRP<br>SPWRPLVLLIPLRLGLTDINEAYVETLK<br>HCFMMPQSLGVIGGKPNSAHYFIGYVG<br>EELIYLDPHTTQPAVEPTDGCFIPDESFH<br>CQHPPCRMSIAELDPSIAVGFFCKTEDD<br>FNDWCQQVKKLSLLGGALPMFELVEL<br>QPSHLACPDVLNLSLDSSDVERLERFFD<br>SEDEDFEILSL | 194 |
| 4 | APG4C<br>S166, S177,<br>S224, S398,<br>S408, S451, | NP_835739 | MEATGTDEVDKLKTKFISAWNNMKYS<br>WVLKTKTYFSRNSPVLLLGKCYHFKYE<br>DEDKTLPAESGCTIEDHVIAGNVEEFRK<br>DFISRIWLTYREEFPQIEGSALTTDCGW<br>GCTLRTGQMLLAQGLILHFLGRAWTW<br>PDALNIENSDSESWTSHTVKKFTASFEA<br>SLSGEREFKTPTISLKETIGKYSDDHEM<br>RNEVYHRKIISWFGDSPLALFGLHQLIE<br>YGKKSGKKAGDWYGPAVVAHILRKAV<br>EEARHPDLQGITIYVAQDCTVYNSDVID<br>KQSASMTSDNADDKAVIILVPVRLGGE<br>RTNTDYLEFVKGILSLEYCVGIIGGKPK<br>QSYYFAGFQDDSLIYMDPHYCQSFVDV<br>SIKDFPLETFHCPSPKKMSFRKMDPSCTI<br>GFYCRNVQDFKRASEEITKMLKFSSKE<br>KYPLFTFVNGHSRDYDFTSTTTNEEDLF<br>SEDEKKQLKRFSTEEFVLL | 195 |
| 5 | APG4D<br>S15, S341,<br>S467 | NP_116274 | MNSVSPAAAQYRSSSPEDARRRPEARR<br>PRGPRGPDPNGLGPSGASGPALGSPGA<br>GPSEPDEVDKFKAKFLTAWNNVKYGW<br>VVKSRTSFSKISSIHLCGRRYRFEGEGDI<br>QRFQRDFVSRLWLTYRRDFPPLPGGCL<br>TSDCGWGCMLRSGQMMLAQGLLLHFL<br>PRDWTWAEGMGLGPPELSGSASPSRYH<br>GPARWMPPRWAQGAPELEQERRHRQI<br>VSWFADHPRAPFGLHRLVELGQSSGKK<br>AGDWYGPSLVAHILRKAVESCSDVTRL<br>VVYVSQDCTVYKADVARLVARPDPTA<br>EWKSVVILVPVRLGGETLNPVYVPCVK<br>ELLRCELCLGIMGGKPRHSLYFIGYQDD<br>FLLYLDPHYCQPTVDVSQADFPLESFHC<br>TSPRKMAFAKMDPSCTVGFYAGDRKE<br>FETLCSELTRVLSSSSATERYPMFTLAE<br>GHAQDHSLDDLCSQLAQPTLRLPRTGR<br>LLRAKRPSSEDFVFL | 196 |

TABLE 2-continued

Full-length sequences of autophagy proteins.

| NO | PRODUCT NAME | NCBI Accession | Sequence | SEQ ID NO |
|---|---|---|---|---|
| 6 | APG5L<br>Y35, S225 | NP_004840 | MTDDKDVLRDVWFGRIPTCFTLYQDEI<br>TEREAEPYYLLLPRVSYLTLVTDKVKK<br>HFQKVMRQEDISEIWFEYEGTPLKWHY<br>PIGLLFDLLASSSALPWNITVHFKSFPEK<br>DLLHCPSKDAIEAHFMSCMKEADALKH<br>KSQVINEMQKKDHKQLWMGLQNDRF<br>DQFWAINRKLMEYPAEENGFRYIPFRIY<br>QTTTERPFIQKLFRPVAADGQLHTLGDL<br>LKEVCPSAIDPEDGEKKNQVMIHGIEPM<br>LETPLQWLSEHLSYPDNFLHISIIPQPTD | 197 |
| 7 | APG7L<br>S95, S173 | NP_006386 | MAAATGDPGLSKLQFAPFSSALDVGFW<br>HELTQKKLNEYRLDEAPKDIKGYYYNG<br>DSAGLPARLTLEFSAFDMSAPTPARCCP<br>AIGTLYNTNTLESFKTADKKLLLEQAA<br>NEIWESIKSGTALENPVLLNKFLLLTFA<br>DLKKYHFYYWFCYPALCLPESLPLIQGP<br>VGLDQRFSLKQIEALECAYDNLCQTEG<br>VTALPYFLIKYDENMVLVSLLKHYSDF<br>FQGQRTKITIGVYDPCNLAQYPGWPLR<br>NFLVLAAHRWSSSFQSVEVVCFRDRTM<br>QGARDVAHSIIFEVKLPEMAFSPDCPKA<br>VGWEKNQKGGMGPRMVNLSECMDPK<br>RLAESSVDLNLKLMCWRLVPTLDLDK<br>VVSVKCLLLGAGTLGCNVARTLMGWG<br>VRHITFVDNAKISYSNPVRQPLYEFEDC<br>LGGGKPKALAAADRLQKIFPGVNARGF<br>NMSIPMPGHPVNFSSVTLEQARRDVEQ<br>LEQLIESHDVVFLLMDTRESRWLPAVIA<br>ASKRKLVINAALGFDTFVVMRHGLKKP<br>KQQGAGDLCPNHPVASADLLGSSLFAN<br>IPGYKLGCYFCNDVVAPGDSTRDRTLD<br>QQCTVSRPGLAVIAGALAVELMVSVLQ<br>HPEGGYAIASSSDDRMNEPPTSLGLVPH<br>QIRGFLSRFDNVLPVSLAFDKCTACSSK<br>VLDQYEREGFNFLAKVFNSSHSFLEDLT<br>GLTLLHQETQAAEIWDMSDDETI | 198 |
| 9 | APG8b<br>T12, S101 | NP_073729 | MPSEKTFKQRRTFEQRVEDVRLIREQHP<br>TKIPVIIERYKGEKQLPVLDKTKFLVPD<br>HVNMSELIKIIRRRLQLNANQAFFLLVN<br>GHSMVSVSTPISEVYESEKDEDGFLYM<br>VYASQETFGMKLSV | 199 |
| 10 | APG8c<br>S137,<br>S137/S138,<br>S138 | NP_073729 | MPSEKTFKQRRTFEQRVEDVRLIREQHP<br>TKIPVIIERYKGEKQLPVLDKTKFLVPD<br>HVNMSELIKIIRRRLQLNANQAFFLLVN<br>GHSMVSVSTPISEVYESEKDEDGFLYM<br>VYASQETFGMKLSV | 200 |
| 11 | APG9L1<br>S14, Y209,<br>S613, S735,<br>S738, S741,<br>S828 | NP_076990 | MAQFDTEYQRLEASYSDSPPGEEDLLV<br>HVAEGSKSPWHHIENLDLFFSRVYNLH<br>QKNGFTCMLIGEIFELMQFLFVVAFTTF<br>LVSCVDYDILFANKMVNHSLHPTEPVK<br>VTLPDAFLPAQVCSARIQENGSLITILVI<br>AGVFWIHRLIKFIYNICCYWEIHSFYLH<br>ALRIPMSALPYCTWQEVQARIVQTQKE<br>HQICIHKRELTELDIYHRILRFQNYMVA<br>LVNKSLLPLRFRLPGLGEAVFFTRGLKY<br>NFELILFWGPGSLFLNEWSLKAEYKRG<br>GQRLELAQRLSNRILWIGIANFLLCPLIL<br>IWQILYAFFSYAEVLKREPGALGARCW<br>SLYGRCYLRHFNELEHELQSRLNRGYK<br>PASKYMNCFLSPLLTLLAKNGAFFAGSI<br>LAVLIALTIYDEDVLAVEHVLTTVTLLG<br>VTVTVCRSFIPDQHMVFCPEQLLRVILA<br>HIHYMPDHWQGNAHRSQTRDEFAQLF<br>QYKAVFILEELLSPIVTPLILIFCLRPRAL<br>EIIDFFRNPFTVEVVGVGDTCSFAQMDV<br>RQHGHPQWLSAGQTEASVYQQAEDGK<br>TELSLMHFAITNPGWQPPRESTAFLGFL<br>KEQVQRDGAAASLAQGGLLPENALFTS<br>IQSLQSESEPLSLIANVVAGSSCRGPPLP<br>RDLQGSRHRAEVASALRSFSPLQPGQA | 201 |

TABLE 2-continued

Full-length sequences of autophagy proteins.

| NO | PRODUCT NAME | NCBI Accession | Sequence | SEQ ID NO |
|---|---|---|---|---|
| | | | PTGRAHSTMTGSGVDARTASSGSSVWE GQLQSLVLSEYASTEMSLHALYMHQLH KQQAQAEPERHVWHRRESDESGESAP DEGGEGARAPQSIPRSASYPCAAPRPGA PETTALHGGFQRRYGGITDPGTVPRVPS HFSRLPLGGWAEDGQSASRHPEPVPEE GSEDELPPQVHKV | |
| 12 | APG10L S116 | NP_113670 | MEEDEFIGEKTFQRYCAEFIKHSQQIGD SWEWRPSKDCSDGYMCKIHFQIKNGSV MSHLGASTHGQTCLPMEEAFELPLDDC EVIETAAASEVIKYEYHVLYSCSYQVPV LYFRASFLDGRPLTLKDIWEGVHECYK MRLLQGPWDTITQQEHPILGQPFFVLHP CKTNEFMTPVLKNSQKINKNVNYITSW LSIVGPVVGLNLPLSYAKATSQDERNVP | 202 |
| 13 | APG12L S26, S41 | NP_004698 | MTSREHQVSLCNCVPLLRRLLCDAPWR KARPLHALSRYFRSRVSPSKMAEEPQS VLQLPTSIAAGGEGLTDVSPETTTPEPPS SAAVSPGTEEPAGDTKKKIDILLKAVGD TPIMKTKKWAVERTRTIQGLIDFIKKFL KLVASEQLFIYVNQSFAPSPDQEVGTLY ECFGSDGKLVLHYCKSQAWG | 203 |
| 14 | APG16L S287, S304 | NP_110430 | MSSGLRAADFPRWKRHISEQLRRRDRL QRQAFEEIILQYNKLLEKSDLHSVLAQK LQAEKHDVPNRHEISPGHDGTWNDNQ LQEMAQLRIKHQEELTELHKKRGELAQ LVIDLNNQMQRKDREMQMNEAKIAEC LQTISDLETECLDLRTKLCDLERANQTL KDEYDALQITFTALEGKLRKTTEENQEL VTRWMAEKAQEANRLNAENEKDSRRR QARLQKELAEAAKEPLPVEQDDDIEVIV DETSDHTEETSPVRAISRAATKRLSQPA GGLLDSITNIFGRRSVSSFPVPQDNVDT HPGSGKEVRVPATALCVFDAHDGEVN AVQFSPGSRLLATGGMDRRVKLWEVF GEKCEFKGSLSGSNAGITSIEFDSAGSYL LAASNDFASRIWTVDDYRLRHTLTGHS GKVLSAKFLLDNARIVSGSHDRTLKLW DLRSKVCIKTVFAGSSCNDIVCTEQCV MSGHFDKKIRFWDIRSESIVREMELLGK ITALDLNPERTELLSCSRDDLLKVIDLRT NAIKQTFSAPGFKCGSDWTRVVFSPDG SYVAAGSAEGSLYIWSVLTGKVEKVLS KQHSSSINAVAWSPSGSHVVSVDKGCK AVLWAQY | 204 |
| 15 | BECN1 S64, T72, S249 | NP_003757 | MEGSKTSNNSTMQVSFVCQRCSQPLKL DTSFKILDRVTIQELTAPLLTTAQAKPG ETQEEETNSGEEPFIETPRQDGVSRRFIP PARMMSTESANSFTLIGEASDGGTMEN LSRRLKVTGDLFDIMSGQTDVDHPLCE ECTDTLLDQLDTQLNVTENECQNYKRC LEILEQMNEDDSEQLQMELKELALEEE RLIQELEDVEKNRKIVAENLEKVQAEA ERLDQEEAQYQREYSEFKRQQLELDDE LKSVENQMRYAQTQLDKLKKTNVFNA TFHIWHSGQFGTINNFRLGRLPSVPVEW NEINAAWGQTVLLLHALANKMGLKFQ RYRLVPYGNHSYLESLTDKSKELPLYC SGGLRFFWDNKFDHAMVAFLDCVQQF KEEVEKGETRFCLPYRMDVEKGKIEDT GGSGGSYSIKTQFNSEEQWTKALKFML TNLKWGLAWVSSQFYNK | 205 |
| APG8b | microtubule-associated protein 1 light chain 3 beta [Bos taurus] | NP_001001169.1 | MPSEKTFKQRRTFEQRVEDVRLIREQHP TKIPVIIERYKGEKQLPVLDKTKFLVPD HVNMSELIKIIRRRLQLNANQAFFLLVN GHSMVSVSTPICEVYESEKDEDGFLYM VYASQETFGMKLSV | 206 |

TABLE 2-continued

Full-length sequences of autophagy proteins.

| NO | PRODUCT NAME | NCBI Accession | Sequence | SEQ ID NO |
|---|---|---|---|---|
| APG10L | hypothetical protein LOC641330 [*Danio rerio*] | NP_001032201.1 | MMTGERKPASCFLDENTFRLCCRLFLQ HSESIQDGWIWEQIKGSDEGFMKKTVLI PVKSSLLDKQHESIQAENTELPTDDFEA DAEDETAGVDAVCESHAVLRYEYHVL YSCSYQIPVLYFRASALDGRSLSLEEVW SNVHPNYRQRLKQEPWDTLTQQEHPLL GQPFFMLHPCRTEEFMKPALELAHAQN RRVNYIVSWLSVVGPVVGLDVPLSFST AVSAPD | 207 |
| APG10L | autophagy-related 10-like [*Mus musculus*] | NP_080046.3 | MEDEFFGEKSFQHYCAEFIRHSQQIGDG WEWRTAKECSDGYMCKTQFRIKNETL TPHASVLTCLPTEENLELPMDDSEVTRP AAVAEVIKHEYHVLYSCSYQVPVLYFR ASFLDGRPLALEDIWEGVHECYKPRLL QGPWDTITQQEHPILGQPFFVLHPCKTN EFMTAVLKNSQKINRNVNYITSWLSLV GPVVGLNLPLSYAKATSQSE | 208 |
| APG10L | PREDICTED: similar to autophagy-related 10-like [*Rattus norvegicus*] | XP_001067400.1 | MEDEFFGEESFQHCCAEFIRHSQQIGDG WEWRTAKECSDGYMCKTQFQIKKETP TPHRETPASVHTCLPTEENLELPVDDSE AVGPAAAAVIRQEYHVLYSCSYQVPVL YFRASFLDGRPLALEDIWEGVHECYKL RLLQGPWDTITQQEHPILGQPFFVLHPC KTNEFMTAVLKNSQKINRNVNYITSWL SIVGPVVGLNLPLSYAKATSQSE | 209 |
| APG10L | PREDICTED: hypothetical protein [*Pan troglodytes*] | XP_517669.1 | MEEDEFIGEKTFQRYCAEFIKHSQQIGD SWEWRPSKDCSDGYMCKIHFQIKNGSV MSHLGASTHGQTCLPMEEAFELPLDDC EVIETAAASEVIKYEYHVLYSCSHQVPV LYFRASFLDGRPLTLKDIWEGVHECYK MRLLQGPWDTITQQEHPILGQPFFVLHP CKTNEFMTPVLKNSQKINKNVNYITSW LSIVGPVVGLNLPLSYAKATSQDERNVH | 210 |
| APG10L | PREDICTED: similar to APG10 autophagy 10-like [*Canis familiaris*] | XP_852603.1 | MEEDEFFGEKTFQHFCAEFIKHSQQIGD GWEWRTSKDCSEGYMCKTHFQIKPGM PMSPPGTSAHIQTCLPMEEALELPLDDF EKTETTTGSEVIKYEYHVLYSCSYQVPV LYFRASFLDGRPLALKDIWEGTHECYK TRLLQEPWDTITQQEHPILGQPFFVLHP CKTNEFMTPVLKNSRKINRSVNYITSW LSVVGPVVGLNLPLSYARTASQDEGNVN | 211 |
| APG10L | PREDICTED: hypothetical protein [*Bos taurus*] | XP_869807.2 | MEENEFFGEKTFQHYCAEFIKHSQKIGD GWEWRASKDCSDGYMCKTHFQVKNG TAVSHQGTSDHVQTFLPVEEALDPPLD DLEVNETTTAAEVIKYEYHVLYSCSYQ VPVLYFRASFLDGRPLALKDIWEGVHE CYKMRLLQGPWDTITQQDKRVHRKNQ GSTTKTAALVWSLTKRVKGLLRSNFPN YKHKVPTPPHAVALGLSLSASEPAPRV CSERLRRAPGSCKGFWDW | 212 |
| APG12 | APG12 autophagy 12-like [*Homo sapiens*] | NP_004698.2 | MTSREHQVSLCNCVPLLRRLLCDAPWR KARPLHALSRYFRSRVSPSKMAEEPQS VLQLPTSIAAGGEGLTDVSPETTTPEPPS SAAVSPGTEEPAGDTKKKIDILLKAVGD TPIMKTKKWAVERTRTIQGLIDFIKKFL KLVASEQLFIYVNQSFAPSPDQEVGTLY ECFGSDGKLVLHYCKSQAWG | 213 |
| APG12L | autophagy 12-like [*Rattus norvegicus*] | NP_001033584.1 | MAEDPEAVLQLPAAPAAAAGESLLELS PETAIPEPPSSVAVSPGTEEPPGDTKKKI DILLKAVGDTPIMKTKKWAVERTRTVQ ALIDFIRKFLRLLASEQLFIYVNQSFAPS PDQEVGTLYECFGSDGKLVLHYCKSQA WG | 214 |

TABLE 2-continued

Full-length sequences of autophagy proteins.

| NO | PRODUCT NAME | NCBI Accession | Sequence | SEQ ID NO |
|---|---|---|---|---|
| APG12L | ATG12 autophagy related 12 homolog [Bos taurus] | NP_001070450.1 | MAEEQESALQLPPSTAPEAEVPTEVSPE TATPEPPSSAAVSPGTEEPVGDTKKKIDI LLKAVGDTPIMKTKKWAVERTRTIQGL FDFIKKFLKLVASEQLFIYVNQSFAPSPD QEVGTLYECFGSDGKLVLHYCKSQAWG | 215 |
| APG12L | autophagy-related 12-like [Mus musculus] | NP_080493.2 | MSEDSEVVLQLPSAPVGAGGESLPELSP ETATPEPPSSAAVSPGTEEPPGDTKKKI DILLKAVGDTPIMKTKKWAVERTRTIQ GLIDFIKKFLKLVASEQLFIYVNQSFAPS PDQEVGTLYECFGSDGKLVLHYCKSQA WG | 216 |
| APG12L | PREDICTED: hypothetical protein [Pan troglodytes] | XP_001167385.1 | MVEEPQSMLQLPPSSATGEEGLTEVSPE TTTLEPPSSAAVSPGTEEPAGDTKKKIDI LLKAVGDTPIMKTKKWAVE | 217 |
| APG12L | PREDICTED: hypothetical protein [Gallus gallus] | XP_424963.1 | MAEAEEQAPVSPQSEGRSGAGEEAPER TPESGASLGVGEPATSPAGSPGTEDPAG DAKKKIDVLLKAVGDTPIMKTKKWAV ERTRTIQGLCDFIKKFLKLMASEQLFIY VNQSFAPSPDQEVGTLYECFGSDGKLV LHYCKSQAWG | 218 |
| APG12L | PREDICTED: similar to Autophagy protein 12-like (APG12-like) (ATG12) isoform 1 [Canis familiaris] | XP_531866.2 | MAEESESGLQLPPSTAAEGEGPTEVSPE TATPEPPSSAAVSPGTEEPAGDTKKKID VLLKAVGDTPIMKTKKWAVERTRTIQG LIDFIKKFLKLVASEQLFIYVNQSFAPSP DQEVGTLYECFGSDGKLVLHYCKSQA WG | 219 |
| APG16L | ATG16 autophagy related 16-like 1 [Danio rerio] | NP_001017854.1 | MAGRRVECLWKRHVVEQLKQRDRVQ RQAFEEIIHQYNRLLEKSDLQVVFSERL QTEKYEQQNRHDLSPCVDGGRSDSLQQ EMSQMRIRHQEELTELHKKRGELAQSV IELNNQIQQKDKEIQSNEVKMQEYLQQI SQLEGECRELRNCLADLERANQTLRDE YDALQITFSALEEKLRKTTEDNQELVTR WMAEKAQEANRLNAENEKDSRRRQA KLQKELADAAKEPLPIDPDDDIEVLTED AGKATGETSPSRQLSRTPSKRLSQPPPP AGLLDSISNMFGRRRSVNSFSSSPENAE VPSACADVRVPSTALHIFDAHDGEVNA VICR | 220 |
| APG16L | APG16L beta isoform [Mus musculus] | NP_084122.2 | MSSGLRAADFPRWKRHIAEELRRRDRL QRQAFEEIILQYTKLLEKSDLHSVLTQK LQAEKHDMPNRHEISPGHDGAWNDSQ LQEMAQLRIKHQEELTELHKKRGELAQ LVIDLNNQMQQKDKEIQMNEAKISEYL QTISDLETNCLDLRTKLQDLEVANQTL KDEYDALQITFTALEEKLRKTTEENQEL VTRWMAEKAQEANRLNAENEKDSRRR QARLQKELAEAAKEPLPVEQDDDIEVIV DETSDHTEETSPVRAVSRAATKRLSQP AGGLLDSITNIFGRRSVSSIPVPQDIMDT HPASGKDVRVPTTASYVFDAHDGQEVN AVQFSPGSRLLATGGMDRRVKLWEAF GDKCEFKGSLSGSNAGITSIEFDSAGAY LLAASNDFASRIWTVDDYRLRHTLTGH SGKVLSAKFLLDNARIVSGSHDRTLKL WDLRSKVCIKTVFAGSSCNDIVCTEQC VMSGHFDKKIRFWDIRSESVVREMELL GKITALDLNPERTELLSCSRDDLLKVID LRTNAVKQTFSAPGFKCGSDWTRVVFS PDGSYVAAGSAEGSLYVWSVLTGKVE KVLSKQHSSSINAVAWAPSGLHVVSVD KGSRAVLWAQP | 221 |

TABLE 2-continued

Full-length sequences of autophagy proteins.

| NO | PRODUCT NAME | NCBI Accession | Sequence | SEQ ID NO |
|---|---|---|---|---|
| | APG16L PREDICTED: similar to APG16L beta isoform [Rattus norvegicus] | XP_343620.3 | MSSGLRAADFPRWKRHIAEELRRRDRL QRQAFEEIILQYTKLLEKSDLHSVLTQK LQAEKHDVPNRHEISPGHDGAWNDSQL QEMAQLKMKHQEELTELHKKRGELAQ LVIDLNNQMQQKDKEIQTNEAKIAECL QTISDLEADCLDLRTKLQDLEVANQTL KDEYDALQITFTALEEKLRKTTEENQEL VTRWMAEKAQEANRLNAENEKDSRRR QARLQKELAEAAKEPLPVEQDDDIEVIV DETSDHTEETSPVRAISRAATRRSVSSIP VPQDVVDTHPASGKDVRVPTTASYVFD AHDGEVNAVQFSPGSRLLATGGMDRR VKLWEAFGDKCEFKGSLSGSNAGITSIE FDSAGAYLLAASNDFASRIWTVDDYRL RHTLTGHSGKVLSAKFLLDNARIVSGS HDRTLKLWDLRSKVCIKTVFAGSSCND IVCTEQCVMSGHFDKKIRFWDIRSESVV REMELLGKITALDLNPERTELLSCSRDD LLKIIDLRTNAIKQSFSAPGFKCGSDWT RVVFSPDGSYVAAGSADGSLYVWSVL TGKVEKVLSKQHSSSINAVAWAPSGLH VVSVDKGSRAVLWAQP | 222 |
| | APG16L PREDICTED: similar to APG16L beta [Gallus gallus] | XP_422568.2 | MASGLHAAGFPPWKRHIAAELRRRDRL QRQAFEEIVAQYNKLLEKSDLHAVLAD KLQAEKYDMQSRHEISPGHDGTWNDA QLQELAQLKIKHQEELTELHKKRGELA QSVIDLNNQMQQKDKEMQMNEAKIAE YLQKISELETECQELRSKLQDLERANQT LKDEYDALQITFNALEEKLRKTTEDNQ ELVSRWMAEKAQEANRLNAENEKDSR RRQARLQKELAEAAKEPLPVEPDDDIE VLADETSDTAEETSPVRAVSRTPSKRLS QPAGGLLDSITNIFGRRSLSSFPPPQDNA EPHPGASKEVRVPTTAICVFDAHDGEV NAVQFSPGSRLLATGGMDRRVKLWEV LGDRCEPKGSLSGSNAGITSIEFDSAGS YLLAASNDFASRIWTVDDNRLRHTLTG HSGKVLSAKFLLDNARIVSGSHDRTLK LWDLRSKVCIKTVFAGSSCNDIVCTEQ CVMSGHFDKKIRFWDIRTESIVKELELL GRITALDLNSERTELLTCSRDDLLKIIDL RVGAVKQTFSAQGFKCGSDWTRVVFS PDGNYVAAGSADGALYVWNVLTGKLE RTLAKHHSSPINAVAWSPAGAHVVSVD KGNKAVLWSEF | 223 |
| | APG16L PREDICTED: similar to Autophagy protein 16-like (APG16-like) isoform 3 [Canis familiaris] | XP_862068.1 | MSSGLRAADFPRWKRHISEELRRRDRL QRQAFEEIILQYNKLLEKSDLHSVLAHK LQAEKHDIPNRHEISPGHDGAWNDGQL QEMAQLRIRHQEELTELHKKRGELAQL VIDLNNQMQQKDREMQMNEAKIAECL QTISDLETECQELRSKLQDLERANQTLK DEYDALQITFTALEEKLRKTTEENQELV TRWMAEKAQEANRLNAENEKDSRRRQ ARLQKELAEAAKEPLPVEQDDDIEVIVD ETSDHAEETSPVRAISRAATKRLSQPAG GLLDSITNIFGLSESPLLGHHSSDAARRR SVSSFPVPQDNVDTHPGSSKEVRVPTTA MCIFDAHDGEVNAVQFSPGSRLLATGG MDRRVKLWEVFGDKCEFKGSLSGSNA GITSIEFDSAGSYLLAASNDFASRIWTV DDYRLRHTLTGHSGKVLSAKFLLDNAR IVSGSHDRTLKLWDLRSKVCIKTVFAGS SCNDIVCTEQCVMSGHFDKKIRFWDIRS ESIVREMELLGKITALDLNPERTELLSCS RDDLLKIIDLRINAVRQTFSAPGFKCGS DWTRVVFSPDGGYVAAGSAEGSLYIW SVLSGKVEKVLSKQHGSSINAVAWSPS GSHVVSVDKGSKAVLWSEY | 224 |
| | APG16L PREDICTED: similar to APG16L | XP_877095.2 | MSSGLRAAVFPRWKRHISEELRRRDRL QRQAFEEIILQYNKLLEKSDLHSVLAHK LQAEKHDVPNRHEISPGHDGSWNDSQL | 225 |

TABLE 2-continued

Full-length sequences of autophagy proteins.

| NO | PRODUCT NAME | NCBI Accession | Sequence | SEQ ID NO |
|---|---|---|---|---|
| | beta isoform 5 [Bos taurus] | | QEMAQLRIKHQEELTELHKKRGELAQL VIDLNNQMQQKDKEMQMNEAKIAEYL QTISDLETECQELRTKLQDLERANQTLK DEYDALQITFTALEEKLRKTSEENQELV TRWMAEKAQEANRLNAENEKDSRRQ ARLQKELAEAAKEPLPVEQDDDIEVLV DETSEHPEETSPVRAISRAATKRLSQPA GGLLDSITNIFGRRSVSSFPVPQDNVDP HPGAGKEVRVPTTAMSVFDAHDGEVN AVQFSPGSRLLATGGMDRRVKLWEVF GDKCEFKGSLSGSNAGITSIEFDSAGSY LLAASNDFASRIWTVDDYRLRHTLTGH SGKVLSAKFLLDNARIVSGSHDRTLKL WDLRSKVCIKTVFAGSSCNDIVCTEQC VMSGHFDKKIRFWDIRSESIVREMELLG KITALDLNPERTELLSCSRDDLLKIIDLRI NAVRQTFSAPGFKCGSDWTRAVFSPDG SYVAAGAAEGSLYIWNVLSGKVEKVLS KHHSSSINAVAWSPAGSHVVTVDKGSK AVLWSEY | |
| APG3 | Apg3p [Homo sapiens] | NP_071933.2 | MQNVINTVKGKALEVAEYLTPVLKESK FKETGVITPEEFVAAGDHLVHHCPTWQ WATGEELKVKAYLPTGKQFLVTKNVP CYKRCKQMEYSDELEAIIEEDDGDGGW VDTYHNTGITGITEAVKEITLENKDNIR LQDCSALCEEEEDEDEGEAADMEEYEE SGLLETDEATLDTRKIVEACKAKTDAG GEDAILQTRTYDLYITYDKYYQTPRLW LFGYDEQRQPLTVEHMYEDISQDHVKK TVTIENHPHLPPPPMCSVHPCRHAEVM KKIIETVAEGGGELGVHMYLLIFLKFVQ AVIPTIEYDYTRHFTM | 226 |
| APG3L | ATG3 autophagy related 3 homolog [Bos taurus] | NP_001068832.1 | MQNVINTVKGKALEVAEYLTPVLKESK FKETGVITPEEFVAAGDHLVHHCPTWQ WATGEELKVKAYLPSGKQFLVTKNVP CYKRCKQMEYSDELEAIIEEDDGDGGW VDTYHNTGIAGITEAVKEITLESKDSIKL QDCSALCEEEEEEDEGEAADMEEYEES GLLETDEATLDTRKIVEACKAKTDAGG EDAILQTRTYDLYITYDKYYQTPRLWL FGYDEQRQPLTVEHMYEDISQDHVKKT VTIENHPHLPPPPMCSVHPCRHAEVMK KIIETVAEGGGELGVHMYLLIFLKFVQA VIPTIEYDYTRHFTM | 227 |
| APG3L | autophagy Apg3p/Aut1 p-like [Mus musculus] | NP_080678.1 | MQNVINTVKGKALEVAEYLTPVLKESK FKETGVITPEEFVAAGDHLVHHCPTWQ WATGEELKVKAYLPTDKQFLVTKNVP CYKRCKQMEYSDELEAIIEEDDGDGGW VDTYHNTGITGITEAVKEITLESKDSIKL QDCSALCDEEDEEDEGEAADMEEYEES GLLETDEATLDTRKIVEACKAKADAGG EDAILQTRTYDLYITYDKYYQTPRLWL FGYDEQRQPLTVEHMYEDISQDHVKKT VTIENHPHLPPPPMCSVHPCRHAEVMK KIIETVAEGGGELGVHMYLLIFLKFVQA VIPTIEYDYTRHFTM | 228 |
| APG3L | autophagy-related 3 [Rattus norvegicus] | NP_599221.1 | MQNVINTVKGKALEVAEYLTPVLKESK FKETGVITPEEFVAAGDHLVHHCPTWQ WATGEELKVKAYLPTGKQFLVTKNVP CYKRCKQMEYSDELEAIIEEDDGDGGW VDTYHNTGITGITEAVKEITLESKDSIKL QDCSVLCDEEEEEEGEAADMEEYEES GLLETDEATLDTRRIVEACKAKADAGG EDAILQTRTYDLYITYDKYYQTPRLWL FGYDEQRQPLTVEHMYEDISQDHVKKT VTIENHPHLPPPLMCSVHPCRHAEVMK KIIETVAEGGGELGVHMYLLIFLKFVQA VIPTIEYDYTRHFTM | 229 |
| APG3L | Aut1 CG6877-PA | NP_649059.1 | MQSVLNTVKGTALNVAEYLTPVLKESK FRETGVLTPEEFVAAGDHLVHHCPTWQ | 230 |

TABLE 2-continued

Full-length sequences of autophagy proteins.

| NO | PRODUCT NAME | NCBI Accession | Sequence | SEQ ID NO |
|---|---|---|---|---|
| | [Drosophila melanogaster] | | WAAGDETKTKPYLPKDKQFLITRNVPC YRRCKQMEYVGEETLVEEESGDGGWV ETHQLNDDGTTQLEDKICELTMEETKE EMHTPDSDKSAPGAGGQAEDEDDDEAI DMDDFEESGMLELVDPAVATTTRKPEP EAKASPVAAASGDAEASGDSVLHTRTY DLHISYDKYYQTPRLWVVGYDEQRKPL TVEQMYEDVSQDHAKKTVTMESHPHL PGPNMASVHPCRHADIMKKIIQTVEEG GGQLGVHLYLIIFLKFVQTVIPTIEYDFT QNFNMS | |
| APG3L | APG3 autophagy 3-like [Danio rerio] | NP_956316.1 | MQNVINSVKGTALGVAEFLTPVLKESK FKETGVITPEEFVAAGDHLVHHCPTWK WASGEEAKVKPYLPNDKQFLLTRNVPC YKRCKQMEYSDELEAIIEEDDGDGGWV DTFHNSGVTGVTEAVREISLDNKDNMN MNVKTGACGNSGDDDDDEEGEAADM EEYEESGLLETDDATLDTSKMADLSKT KAEAGGEDAILQTRTYDLYITYDKYYQ TPRLWLFGYDEDRQPLTVDQMYEDISQ DHVKKTVTIENHPNLPPPAMCSVHPCR HAEVMKKIIETVAEGGGELGVHMYLLI FLKFVQAVIPTIEYDYTRHFTM | 231 |
| APG3L | PREDICTED: hypothetical protein isoform 1 [Pan troglodytes] | XP_001155234.1 | MQNVINTVKGKALEVAEYLTPVLKESK FKETGVITPEEFVAAGDHLVHHCPTWQ WATGEELKVKAYLPTGKQFLVTKNVP CYKRCKQMEYSDELEAIIEEDDGDGGW VDTYHNTGITGITEAVKEITLENKDNIR LQDCSALCEEEEDEDEGEAADMEEYEE SGLLETDEATLDTRKIVEACKAKTDAG GEDAILQTRTYDLYITYDKYYQTPRLW LFGYDEQRQPLTVEHMYEDISQDHVKK TVTIENHPHLPPPPMCSVHPCRHAEVM KKIIETVAEGGGELGVHMYLLIFLKFVQ AVIPTIEYDYTRHFTM | 232 |
| APG3L | AGAP011582-PA [Anopheles gambiae str. PEST] | XP_309926.3 | MQNVLNSVKGTALGVAEYLTPVLKES KFRETGVLTPEEFIAAGDHLTHHCPTWS WAVGDESKIKPYLPKDKQFLITRNVPC RRRCKQIEFVGEENLVEENDPDGGWVE THHYNPDEAGSSGLEDKVCEMKLDSSR IEDEPAADMDDPRNLEDGDGDGGQDD DEDGAAIDMDEFEESGLLEMVDPSNAL LPAPNEKPKPTVAASETEGDSVVRTRT YDLHITYDKYYQTPRLWVIGYDENRKL LSVEQMYDDVSQDHAKKTVTMETHPH LPGPNMASVHPCKHADIMKKIIQTVEE GGGELGVHMYLIIFLKFVQTVIPTIEYDF TQNFNITNHK | 233 |
| APG3L | PREDICTED: hypothetical protein [Gallus gallus] | XP_416588.1 | MQNVINTVKGKALEVAEYLTPVLKESK FKETGVITPEEFVAAGDHLVHHCPTWQ WASGEELKVKAYLPTDKQFLVTKNVP CYKRCKQMEYSDEQEAIIEEDDGDGG WVDTFHNAGIVGATEAVKEITLDSKDN IKIPERSASCEDDDDEDEGEAADMEEYE ESGLLETDDATLDTRQIVEVKAKVDVG GEDAILQTRTYDLYITYDKYYQTPRLW LFGYDEQRQPLTVEHMYEDISQDHVKK TVTIENHPHLPPPMCSVHPCRHAEVM KKIIETVAEGGGELGVHMYLLIFLKFVQ AVIPTIEYDYTRHFTM | 234 |
| APG3L | PREDICTED: similar to Apg3p [Canis familiaris] | XP_535740.2 | MCINTVKGKALEVAEYLTPVLKESKFK ETGVITPEEFVAAGDHLVHHCPTWQW ATGEELKVKAYLPTGKQFLVTKNVPCY KRCKQMEYSDELEAIIEEDDGDGGWVD TYHNAGVTGITEAVKEITLESKDSIKLQ DCSAVCEEEEEEDEGEAADMEEYEESG LLETDEATLDTRKIVEACKAKTDAGGE DAILQTRTYDLYITYDKYYQTPRLWLF GYDEQRQPLTVEHMYEDISQDHVKKT | 235 |

TABLE 2-continued

Full-length sequences of autophagy proteins.

| NO | PRODUCT NAME | NCBI Accession | Sequence | SEQ ID NO |
|---|---|---|---|---|
| | | | VTIENHPHLPPPPMCSVHPCRHAEVMK KIIETVAEGGGELGVHMYLLIFLKFVQA VIPTIEYDYTRHFTM | |
| APG4A | autophagy-related cysteine endopeptidase 2 [Bos taurus] | NP_001001171.1 | MESVLSKYENQITIFADYLEEFPDTDEL VWILGKQHLLKTEKSKLLSDISARLWFT YRRKFSPIGGTGPSSDAGWGCMLRCGQ MMLAQALICRHLGRDWNWEKQKEQP KEYQRILQCFLDRKDCCYSIHQMAQMG VGEGKSIGEWFGPNTVAQVLKKLALFD EWNSLAVYVSMDNTVVIEDIKKMCRTL SLSADTPAERPLESLTASNQSKGPSACC TAWKPLLLIVPLRLGINQINPVYVDAFK ECFKMPQSLGALGGKPNNAYYFIGFLG DELIFLDPHTTQTFVDTEENGTADDQTF HCLQPPQRMNILNLDPSVALGFFCKEE KDFDSWCSLVQKEILKENLRMFELVQK HPSHWPPFVPPAKPEVTTTGAEFIDSTE QLEEFDLEEDFEILSI | 236 |
| APG4A | hypothetical protein LOC554140 [Danio rerio] | NP_001019605.1 | MEAVLAKYENQINVFLEDLPDTDEPVW ILGACYNVKTKKSELLSDVRSRLWFTY RKKFSPIGGTGPSSDAGWGCMLRCGQ MILAQALICSHLGRDWRWDPEKHQPKE YQRILDCFLDKKDSCYSIHQMAQMGV GEGKSVGEWYGPNTVAQVLKKLALFD DWNSLSVYVSMDNTVVIEDIKKLCVRA DLQLQSQQPLDWRPLLLVIPLRMGINSI NPVYIQALKECFKMPQSCGVLGGKPNL AYYFIGFIDDELIYLDPHTTQQAVDTES GSAVDDQSFHCQRTPHRMKITSLDPSV ALGFFCKSEEDFDSWCDLVQQELLKKR NLRMFELVEKHPSHWPPFVPPTKPEVQ TTGAEFIESPDKLSESEEEFEILNA | 237 |
| APG4A | AuTophaGy (yeast Atg homolog) family member (atg-4.1) [Caenorhabditis elegans] | NP_493375.1 | MTEEILKQGVGIVETSLTFEPPFCESFER ISIDNFPIFALGKEISKEDGIEAMKKYVT SRFWFTYRRDFSPIGGTGPSTDQGWGC MLRCAQMLLGEVLLRRHIGRHFEWDIE KTSEIYEKILQMFFDEKDALYSIHQIAQ MGVTEGKEVSKWFGPNTAAQVMKKLT IFDDDWSNIAVHVALDNILVKEDAITMAT SYPSEDAVKLIMGKKGLQTTKRKNRKN LDFTVKYLKQIKFFKFFNLFQIFYENGL VDKNRLSLSPGNIIPEWRPLLLMIPLRLG LTTINPCYLSAIQEFFKIPQCVGIIGGRPN HALYFVGMSGSKLFYLDPHYCRPKTES TAKMYAEKDSTATTDDVGFSHLEELVP LPSQTADVYTKMDDSTYHCQMMLWIE YENVDPSLALAMFCETRDEFENLCETL QKTTLPASQPPMFEFLQRRPKYLPKFEP YTGVSMKIEMKEFDDIGAANVKIDDDF EVLDVHTEEEDADEDNDDDVANA | 238 |
| APG4A | autophagy-related 4A-like [Mus musculus] | NP_777364.3 | MESVMSKYENQILIFPDYLEEFPDTDEL VWILGKQHPLKTEKSKLLSDISARLWFT YRRKFSPIGGTGPSSDAGWGCMLRCGQ MMLAQALICRHLGRDWNWERQKEQP KEYQRILQCFLDRKDCCYSIHQMAQMG VGEGKSIGEWFGPNTVAQVIKKLALFD EWNSLAVYVSMDNTVVIEDIKKMCCV LPVGAADPAGDFLTASNQSRDTSVPCS AWKPLLLIVPLRLGINQINPVYVEAFKE CFKMPQSLGALGGKPNNAYYFIGFLGD ELIFLDPHTTQTFVDIEESGLVDDQTFHC LQSPQRMSILNLDPSVALGFFCKEEKDF DNWCSLVQKEILKENLRMFELVQKHPS HWPPFVPPAKPEVTTTGAEFIESTEQLE DFELEEDFEILSVG | 239 |
| APG4A | PREDICTED: autophagy-related cysteine endopeptidase | XP_529098.2 | MESVLSKYEDQITIFTDYLEEYPDTDEL VWILGKQHLLKTEKSKLLSDISARLWFT YRRKFSPIGGTGPSSDAGWGCMLRCGQ MMLAQALICRHLGRDWSEKQKEQPK EYQRILQCFLDRKDCCYSIHQMAQMGV | 240 |

TABLE 2-continued

Full-length sequences of autophagy proteins.

| NO | PRODUCT NAME | NCBI Accession | Sequence | SEQ ID NO |
|---|---|---|---|---|
| | 2 isoform 8 [Pan troglodytes] | | GEGKSIGEWFGPNTVAQVLKKLALFDE WNSLAVYVSMDNTVVIEDIKKMCRVL PLSIDTPGDRPPDSLTASNQSKGTSAYC SAWKPLLLIVPLRLGINQINPVYVDAFK ECFKMPQSLGALGGKPNNAYYFIGFLG DELIFLDPHTTQTFVDTEENGTVNDQTF HCLQSPQRMNILNLDPSVALGFFCKEE KDFDNWCSLVQKEILKENLRMFELVQK HPSHWPPFVPPAKPEVTTTGAEFIDSTE QLEEFDLEEDFEILSV | |
| APG4A | PREDICTED: similar to autophagy-related cysteine endopeptidase 2 isoform a [Canis familiaris] | XP_538136.2 | MTANQKSGRLWELQFERSSGWRGAFT VLTDSAPSSAELQVPGSLAAAVVKCRV ELAQDDSWRMESVLSKYENQITIFADY LEEFPDSDELVWILGKQHLLKTEKSKLL SDIRARLWFTYRRKFSPIGGTGPSSDAG WGCMLRCGQMMLAQALICRHLGRDW SWEKQKEQPREYQRILQCFLDRKDCCY SIHQMAQMGVGEGKSIGEWFGPNTVA QVLKKLALFDEWNSLAIYVSMDNTVVI EDIKKMCCVLPLSADTIGESPLNTLNAS NQSKSAPASCPAWKPLLLIVPLRLGINQ INPVYVDAFKECFKMPQSLGALGGKPN NAYYFIGFLGDELIFLDPHTTQTFVDTE ENGTVDDQTFHCLQSPQRMNILNLDPS VALGFFCKEEKDFDSWCSLVQKEILKE NLRMFELVQKHPSHWPPFVPPAKPEVT TTGAEFIDSTEQLEDFDLEEDFEILSV | 241 |
| APG4B | APG4 autophagy 4 homolog B [Bos taurus] | NP_001001170.1 | MDAATLTYDTLRFAEFEDFPETSEPVWI LGRKYSVLTEKDEILADVASRLWFTYR KNFPAIGGTGPTSDTGWGCMLRCGQMI FAQALVCRHLGRDWRTQRKRQPDSY CSVLQAFLDRKDSCYSIHQIAQMGVGE GKSIGQWYGPNTVAQVLKKLAVFDTW SALAVHVAMDNTVVMADIRRLCRSSLP CAGAEAFPADSERHCNGFPAGAEGGGR AAPWRPLVLLIPLRLGLADVNAAYAGT LKHCFRMPQSLGVIGGKPNSAHYFIGY VGEELIYLDPHTTQPAVAAADRCPVPD ESPHCQHPPGRMSIAELDPSIAVGFFCET EDDFNDWCQQVSKLSLLGGALPMFEL VEQQPSHLACPDVLNLSLDSSDAERLE RFFDSEDEDFEILSL | 242 |
| APG4B | autophagin 1 [Mus musculus] | NP_777363.1 | MDAATLTYDTLRFAEFEDFPETSEPVWI LGRKYSIFTEKDEILSDVASRLWFTYRR NFPAIGGTGPTSDTGWGCMLRCGQMIF AQALVCRHLGRDWRTQRKRQPDSYF NVLNAFLDRKDSYYSIHQIAQMGVGEG KSIGQWYGPNTVAQVLKKLAVFDTWS SLAVHIAMDNTVVMEEIRRLCRANLPC VGAAALPTDSERHCNGFPAGAEVTNRP SAWRPLVLLIPLRLGLTDINEAYVETLK HCFMMPQSLGVIGGKPNSAHYFIGYVG EELIYLDPHTTQPAVELTDSCFIPDESFH CQHPPSRMGIGELDPSIAVGFFCKTEED FNDWCQQVKKLSQLGGALPMFELVEQ QPSHLACQDVLNLSLDSSDVERLERFFD SEDEDFEILSL | 243 |
| APG4B | APG4 autophagy 4 homolog B [Gallus gallus] | NP_998738.1 | MDAATLTYDTLRFEYEDFPETKEPVWI LGRKYSVFTEKEEILLDVTSRLWFTYRK NFPAIGGTGPTSDTGWGCMLRCGQMIF AQALVCRHLGRDWRIKGKRQTDNYF SVLNAFIDKKDSYYSIHQIAQMGVGEG KSIGQWYGPNTVAQVLKKLATFDTWSS LAVHIAMDNTVVMEEIRRLCQSNFSCA GAAACPAVEADVLYNGYPEEAGVRDK LSLWKPLVLLIPLRLGLTEINEAYIETLK HCFMMPQSLGVIGGKPNSAHYFIGYVG EELIYLDPHTTQPAVEPSDSGCLPDESF HCQHPPCRMSIAELDPSIAVGFFCHTEE | 244 |

TABLE 2-continued

Full-length sequences of autophagy proteins.

| NO | PRODUCT NAME | NCBI Accession | Sequence | SEQ ID NO |
|---|---|---|---|---|
| | | | DFNDWCHQIKKLSLVRGALPMFELVER QPSHFSNPDVLNLTPDSSDADRLERFFD SEDEDFEILSL | |
| APG4B | PREDICTED: similar to APG4 autophagy 4 homolog B isoform b [Pan troglodytes] | XP_001162556.1 | MLRCGQKIFAQALVCRHLGRDWRWTQ RKRQPDSYFSVLNAFIDRKDSYYSIHQI AQMGVGEGKSIGQWYGPNTVAQVLKK LAVFDTWSSLAVHIAMDNTVVMEEIRR LCRTSVPCAGATAFPPADSDRHCNGFPA GAEVTNRLSPWRPLVLLIPLRLGLTDIN EAYVETLKHCFMMPQSLGVIGGKPNSA HYFIGYVGEELIYLDPHTTQPAVEPTDG CFIPDESFHCQHPPCRMSIAELDPSIAVG FFCKTEDDFSDWCQQVKKLSLLGGALP MFELVEQQPSHLACPDVLNLSLGESCQ VQILLM | 245 |
| APG4B | PREDICTED: similar to Cysteine protease APG4B (Autophagy 4 homolog B) (hAPG4B) (Autophagin-1) (Autophagy-related cysteine endopeptidase 1) (AUT-like 1 cysteine endopeptidase) [Canis familiaris] | XP_851977.1 | MLTDATLTYDTLRFAEFEDFPETSEPV WILGRKYSIFTEKDEILSDVASRLWFTY RKNFPAIGGTGPTSDTGWGCMLRCGQ MIFAQALVCRHLGRDWRWTQRKRQPD SYFNVLNAFIDRKDSYYSIHQIAQMGV GEGKSIGQWYGPNTVAQVLKKLAVFD TWSSLAVHIAMDNTVVMEDIRRLCRGS LPCAGAAALPADSSRHCNGFPAGAEVT NRLAPWRPLVLLIPLRLGLTDINEAYVE TLKRCFMMPQSLGVIGGKPNSAHYFIG YVGEELIYLDPHTTQPAVEFTDSCFIPDE SFHCQHPPSRMSIGELDPSIAVGFFCKTE GDFDDWCQQVRQLSLLGGALPMFELV EQQPSHLACPDVLNLSLDSSDVERLERF FDSEDEDFEILSL | 246 |
| APG4C | APG4 autophagy 4 homolog C [Mus musculus] | NP_778194.2 | MEASGTDEVDKLKTKFISAWNNMKYS WVLKTKTYFSRNSPVLLLGKCYHFKYE DESKMLPARSGCAIEDHVIAGNVEEFR KDFISRLWLTYREEFPQIEASALTTDCG WGCTLRTGQMLLAQGLILHFLGRAWT WPDALHIENADSDSWTSNTVKKFTASF EASLSGDRELRTPAVSLKETSGKCPDD HAVRNEAYHRKIISWFGDSPVAVFGLH RLIEFGKKSGKKAGDWYGPAVVAHILR KAVEEARHPDLQGLTIYVAQDCTVYNS DVIDKQTDSVTAGDARDKAVIILVPVRL GGERTNTDYLEFVKGVLSLEYCVGIIGG KPKQSYYFAGFQDDSLIYMDPHYCQSF VDVSIKDFPLETFHCPSPKKMSFRKMDP SCTIGFYCRNVQDFERASEEITKMLKISS KEKYPLFTFVNGHSKDFDFTSTAASEED LFSEDERKNFKRFSTEEFVLL | 247 |
| APG4C | PREDICTED: APG4 autophagy 4 homolog C isoform 2 [Pan troglodytes] | XP_001159784.1 | MEATGTDEVDKLKTKFISAWNNMKYS WVLKTKTYFSRNSPVLLLGKCYHFKYE DEDKTLPAESGCTIEDHVIAGNVEEFRK DFISRIWLTYREEFPQIEGSALTTDCGW GCTLRTGQMLLAQGLILHFLGRAWTW PDALNIENSDSESWTSHTVKKFTASFEA SLSGEREFKTPTISLKETIGKYSDDHEM RNEVYHRKIISWFGDSPLALFGLHQLIE YGKKSGKKAGDWYGPAVVAHILRKAV EEARHPDLQGITIYVAQDCTVYNSDVID KQSASMTSDNADDKAVIILVPVRLGGE RTNTDYLEFVKGILSLEYCVGIIGGKPK QSYYFAGFQDDSLIYMDPHYCQSFVDV SIKDFPLETFHCPSPKKMSFRKMDPSCTI GFYCRNVQDFKRASEEITKMLKFSSKE KYPLFTFVNGHSRDYDFTSTTTNEEDLF SEDEKKQLKRFSTEEFVLL | 248 |

TABLE 2-continued

Full-length sequences of autophagy proteins.

| NO | PRODUCT NAME | NCBI Accession | Sequence | SEQ ID NO |
|---|---|---|---|---|
| APG4C | PREDICTED: similar to putative autophagy-related cysteine endopeptidase isoform 1 [*Bos taurus*] | XP_001250947.1 | MEATGTDDVDKLKTKFISAWNNMKYS WVLKTKTYFSRNSPVLLLGKCYHFKYE DENELLPARSGCTIEDHVIAGNVEEFRK DFISRIWLTYREEFPQIEGSALTTDCGW GCTLRTGQMLLAQGLILHFLGRAWTW PDALNIENSDSESWTSNTVKKFTASFEA SLSGERELKTPTISLKEKMERYSDDREM QNEIYHRKIISWFGDSPLALFGLHQLIEC GKKSGKKAGDWYGPAVVAHILRKAVE EARHPDLKGITIYVAQDCTVYSSDVIDK QCTSMASDNTNDKAVIILVPVRLGGER TNADYLDFVKGILSLEYCVGIIGGKPKQ SYYFAGFQDDSLIYMDPHYCQSFVDVSI KDFPLETFHCPSPKKMSFRKMDPSCTIG FYCRNVQDFKRASEEITKMLKISSKEKY PLFTFVNGHSRDYDFTSTTTNEEDLFSE DEKKRIKRFSTEEFVLL | 249 |
| APG4C | PREDICTED: similar to APG4 autophagy 4 homolog C [*Rattus norvegicus*] | XP_233220.4 | MHLNWKCNRPGLLQIPGWVLKTKTYF SRNSPVLLLGKCYHFKYEDESKVLPAR SGCAIEDHVIAGNVEEFRKDFISRIWLT YREEFPQIEASALTTDCGWGCTLRTGQ MLLAQGLILHFLGRAWTWPDALHIESS DSDSWTSNTIHKFTASFEASLSGERELR TPAVSLKETSGKHPDDHAVQSEIYHRQI ISWFGDSPVAVFGLHRLIEFGKKSGKKA GDWYGPAVVAHILRKAVEEARHPDLQ GLTIYVAQDCTVYNSDVIDKQTDSVTA GDARDKAVIILVPVRLGGERTNIDYLEF VKGVLSLEYCVGIIGGKPKQSYYFAGF QDDSLIYMDPHYCQSFVDVSIKDFPLET FHCPSPKKMSFRKMDPSCTIGFYCRNV QDFERASEEITKMLKISSKEKYPLFTFV NGHSRDFDFTSTAASEEDLFLEDEKKNF KRFSTEEFVLL | 250 |
| APG4C | PREDICTED: similar to putative autophagy-related cysteine endopeptidase [*Gallus gallus*] | XP_422520.2 | MEATGTDEVEKIKSKFMSAWNNMKYS WVLKTKTYFSRNSPVFLLGKCYHFKSD ESGELSTEGSNFDKINTEISGNVEEFRKD FISRIWLTYREEFPQIKGSALTTDCGWG CTLRTGQMLLAQGLMLHFLGRAWVWP DALDIENSDSESWTAHTVKKLTASLEA SLTAEREPKILSHHQERTLRRDCGDSEM RNEVYHRKIISWFGDSPLAAFGLHQLIE YGKKSGKIAGDWYGPAVVAHILRKAV EEARDPELQGVTVYVAQDCTVYSSDVI DRQCSFMDSGETDTKAVIILVPVRLGGE RTNMDYLEFVKGILSLEYCVGIIGGKPK QSYYFAGFQDDSLIYMDPHYCQSFVDV SIKDFPLESFHCPSPKKMSFKKMDPSCTI GFYCRTVQDFEKASEEITKMLKSSSKEK YPLFTFVKGHSRDYDFASSPLHEENDLF SEDEKKRLKRFSTEEFVLL | 251 |
| APG4C | PREDICTED: similar to APG4 autophagy 4 homolog C isoform 4 [*Canis familiaris*] | XP_865426.1 | MEATGTDEVDKLKTKFISAWNNMKYS WVLKTKTYFSRNSPVLLLGKCYHFKFE DENKLLPARSGCTIEDHVIAGNVEEFRK DFISRIWLTYREEFPQIEGSAFTTDCGW GCTLRTGQMLLAQGLILHFLGRAWTW PDALNIENSDSDSWTSNTVKKFTASFEA SLSGESELKTPTVSQKETIRRHSDDHEM RNEIYHRKIISWFGDSPLALFGLHQLIKY GKKSGKKAGDWYGPAVVAHILRKAVE EARHPDLQGITIYVAQDCTVYSSDVIDK QCTSMASDNTDDKAVIILIPVRLGGERT NTDYLDFVKGILSLEYCVGIIGGKPKQS YYFAGFQDDSLIYMDPHYCQSFVDVSI KDFPLETFHCPSPKKMSFRKMDPSCTIG FYCRNVQDFKRASEEITKMLKISSKEKY PLFTFVNGHSRDYDFTSTTTNEEDLFSE DEKKRLKRFSTEEFVLL | 252 |

TABLE 2-continued

Full-length sequences of autophagy proteins.

| NO | PRODUCT NAME | NCBI Accession | Sequence | SEQ ID NO |
|---|---|---|---|---|
| APG4D | CG6194 CG6194-PA [Drosophila melanogaster] | NP_650452.1 | MNYDGLLSKLTDEKLMLFEAAGEGTIV EGSRICGQDADPLSLPLVEDGAIEEEQA APIQTIHRTVFAVPRVPSPSPVSTSGANL NLKTENAATATPQRKISTSSRFMNAFSQ LYGGGNSGPSCGHVEQHNEEPGDLSAN RTPTKGMESKLVAMWHNVKYGWSGK MRQTSFSKEQPVWLLGRCYHRRFTPPV SMESSITELPSGADTTPDNATSAFDSIQA TSTSTSLYPALNPQQIDEIVVPQELGMD AVENQVGEQPWEEGIEGFRRDFYSRIW MTYRREFPIMNGSNYTSDCGWGCMLR SGQMLFAQGLICHFLGRSWRYDSESQL HSTYEDNMHKKIVKWFGDSSSKSSPFSI HALVRLGEHLGKKPGDWYGPASVSYL LKHALEHAAQENADFDNISVYVAKDCT IYLQDIEDQCSIPEPAPKPHVPWQQAKR PQAETTKTEQQQHWKSLIVLIPLRLGSD KLNPVYAHCLKLLLSTEHCLGILGGKP KHSLYFVGFQEDRLIHLDPHYCQEMVD VNQENFSLHSFHCKSPRKLKASKMDPS CCIGFYCATKSDFDNFMESVQLYLHPM RCASGATVDKAAGSHHTTPQSSHQTEQ TEMNYPLFSFSRGRCMDHERDEMSDSL YKPLIKQVASLAQELGAQLAPPQHGDE HDQDDSESEEFVLL | 253 |
| APG4D | APG4-D protein [Mus musculus] | NP_705811.8 | MNSVSPAAAQYRSGSSEDARRADCRRP RGQTRIPDPSNLGPSGSGVAALGSSGTD PAEPDEVDKFKAKFLTAWNNVKYGWA VKSRTSFSKISTVHLCGRCYHFEGEGDI QRFQRDFVSRLWLTYRRDFPPLAGGSL TSDCGWGCMLRSGQMMLAQGLLLHFL PRDWRWVEGTGLASSEMPGPASPSRCR GPGRRGPPRWTQGALEMEQDRWHRRI VSWFADHPRAPFGLHRLVELGRSSGKK AGDWYGPSVVAHILRKAVESCSEVSRL VVYVSQDCTVYKADVARLLSWPDPTA EWKSVVILVPVRLGGETLNPVYVPCVK ELLRSELCLGIMGGKPRHSLYFIGYQDD FLLYLDPHYCQPTVDVSQPSFPLESFHC TSPRKMAFAKMDPSCTVGFYAGNRKE FETLCSELMRILSSSSVTERYPMFTVAE GHAQDHSLDALCTQLSQPTLRLPCTGR LLKAKRPSSEDFVFL | 254 |
| APG4D | PREDICTED: APG4 autophagy 4 homolog D [Pan troglodytes] | XP_512373.2 | MQVLHLAGRCPYVSPGWVVKSRTSFS KISSIHLCGRRYRFEGEGDIQRFQRDFVS RLWLTYRRDFPPLPGGCLTSDCGWGC MLRSGQMMLAQGLLLHFLPRDWTWA EGMGLGPPELSGSASPSRYHGPARWMP PRWAQGAPELEQERRHRQIVSWFADHP RAPFGLHRLVELGQSSGKKAGDWYGP SLVAHILRKAVESCSEVTRLVVYVSQD CTVYKADVARLVARPDPTAEWKSVVIL VPVRLGGETLNPVYVPCVKELLRCELC LGIMGGKPRHSLYFIGYQDDFLLYLDP HYCQPTVDVSQADFPLESFHCTSPRKM AFAKMDPSCTVGFYAGDRKEFETLCSE LTRVLSSSSATERYPMFTLAEGHAQDH SLDDLCSQLAQPTLRLPRTGRLLRAKRP SSEDFVFL | 255 |
| APG4D | PREDICTED: similar to APG4 autophagy 4 homolog D isoform 1 [Canis familiaris] | XP_542069.1 | MNSVSPAAAQYRSGSPEDARRPEGRRP RGPRVPDPNGPRPSGASGPALGSPAAAP GEPDEVDKFKAKFLTAWNNVKYGWA VKSRTSFSKISSVHLCGRRYRFEGEGDI QRFQRDFVSRLWLTYRRDFPPLAGGCL TSDCGWGCMLRSGQMMLAQGLLLHFL PRDWTWAEGPGLGPSEPAGLASPNRYR GPARWMPPRWAQGTPELEQERRHRQI VSWFADHPQAPFGLHRLVELGQSSGKK AGDWYGPSLVAHILRKAVESCSEITRLV VYVSQDCTVYKADVARLVARPDPTAE WKSVVILVPVRLGGETLNPVYVPCVKE | 256 |

TABLE 2-continued

Full-length sequences of autophagy proteins.

| NO | PRODUCT NAME | NCBI Accession | Sequence | SEQ ID NO |
|---|---|---|---|---|
| | | | LLRSELCLGIMGGKPRHSLYFIGYQDDF LLYLDPHYCQPTVDVSQADFPLESFHC TSPRKMAFAKMDPSCTVGFYAGDQKE FETLCSELTRVLSSSSATERYPMFTLAE GHAQDHSLDDLCSQLSQPTLRLPRTGR LLKAKRPSSEDFVFL | |
| APG4D | AGAP004023-PA [*Anopheles gambiae* str. PEST] | XP_554420.3 | AAVRGSDGTKTPGRKISLPPHARRHES VSASCSPMRGGPAANHSTATGGPGEEF KGKVESKLLTMWNNMKFGWSYKMKT NFSKEQPLWLLGRCYHQKITPVTSMES SVELGTSGPDGQLMVLQNVYFAEPSNS PPEETGTDAIEDSSPEAIVEEEGIDAFRR DFISRIWMTYRREFQTMDDSNYTSDCG WGCMIRSGQMLLAQGLVAHFLGRSWR WDVSMFTAYEESIHRKVIRWFGDTSSK TSPFSIHTLVALGKESGKKPGDWYGPG AVAHLLRQAVRLAAQEITDLDGINVYV AQDCAVYIQDILDECTVPATPAGAPWQ RKGAPGGTNSSSSTAHTERSGATSCAE GDEDVQSAHWKSLILLVPLRLGTDKLN PIYNECLKAMLSLDYCIGIIGGRPKHSL YFVGYQEDKLIHLDPHYCQDMVDVNQ DNFPVASFHCKSPRKMKLSKMDPSCCI GFYCETKKDFYKFIDSVKPFLIPVQPGN QDAGYANPSSGSSTGSVSYPMFVFCRG KSSEQRADLPGQQHQYPHPTAYRSPPT AIPQQAAGGNDDDEEDEDEAIEFVIL | 257 |
| APG4D | PREDICTED: similar to AUT-like 4, cysteine endopeptidase isoform 1 [*Bos taurus*] | XP_873804.1 | MNSVSPAAAQYRSGSPEDARRPEGRRP RGPRTPDPHGLGPSGASGPALASPGTGP GEPDEVDKFKAKFLTAWNNVKYGWA VKSRTSFSKISSVHLCGRRYRFEGEGDI QRFQRDFVSRLWLTYRRDFPPLAGGSL TSDCGWGCMLRSGQMMLAQGLLLHFL PRDWTWCQGAGLGPSEPPGLGSPSRRR GPARWLPPRWAQAPELEQERRHRQIVS WFADHPRAPFGLHRLVELGQGSGKKA GDWYGPSLVAHILRKAVESCSEVTRLV VYVSQDCTVYKADVARLVARPDPTAE WKSVVILVPVRLGGETLNPVYVPCVKE LLRSELCLGIMGGKPRHSLYFIGYQDDF LLYLDPHYCQPTVDVSQADFPLESFHC TSPRKMAFAKMDPSCTVGFYAGDRKE FETLCSELTRVLSSSSATERYPMFTLVE GHAQDHSLDDLCSPPSQQTLRLPRSGR LLKAKRPSSEDFVFL | 258 |
| APG5 | APG5 autophagy 5-like [*Homo sapiens*] | NP_004840.1 | MTDDKDVLRDVWFGRIPTCFTLYQDEI TEREAEPYYLLLPRVSYLTLVTDKVKK HFQKVMRQEDISLIWFEYEGTPLKWHY PIGLLFDLLASSSALPWNITVHFKSFPEK DLLHCPSKDAIEAHFMSCMKEADALKH KSQVINEMQKKDHKQLWMGLQNDRF DQFWAINRKLMEYPAEENGFRYIPFRIY QTTTERPFIQKLFRPVAADGQLHTLGDL LKEVCPSAIDPEDGEKKNQVMIHGIEPM LETPLQWLSEHLSYPDNFLHISIIPQPTD | 259 |
| APG5L | APG5 autophagy 5-like [*Gallus gallus*] | NP_001006409.1 | MTDDKDVLRDVWFGRIPTCFTLYQDEI TEREAEPYYLLLPRISYLTLVTDKVKKH FQKVMRQEEVNEIWFEYEGTPLKWHY PIGLLFDLHASNTALPWSITVHFKNFPE KDLLHCHSKDVIEAHFMACIKEADALK HKSQVINEMQKKDHKQLWMGLQNDK FEQFWAINRKLMEYPPEDSGFRYIPFRI YQATTERPFIQKLFRPIASGGQLHTLGD LLKDVCPSAITPEDGEKTTQVMIHGIEP MLETPLQWLSEHMSYPDNFLHISIIPRPTD | 260 |
| APG5L | autophagy protein 5 [*Bos taurus*] | NP_001029751.2 | MTDDKDVLRDVWFGRIPTCFTLYQDEI TEREAEPYYLLLPRVSYLTLVTDKVKK HFQKVMRQEDISEIWFEYEGTPLKWHY PIGLLFDLLASSSALPWNITVHFKSFPEK DLLHCPSKDVIEAHFMSCVKEADALKH | 261 |

TABLE 2-continued

Full-length sequences of autophagy proteins.

| NO | PRODUCT NAME | NCBI Accession | Sequence | SEQ ID NO |
|---|---|---|---|---|
| | | | KSQVINEMQKKDHKQLWMGLQNDRF DQFWAINRKLMEYPAEENGFRYIPFRIY QTTTERPFIQKLFRPVSTDGQLHTLGDL LKEVCPSAVAPEDGEKKNQVMIHGIEP MLETPLQWLSEHLSYPDNFLHISIIPQPTD | |
| APG5L | autophagy-related 5-like [Mus musculus] | NP_444299.1 | MTDDKDVLRDVWFGRIPTCFTLYQDEI TEREAEPYYLLLPRVSYLTLVTDKVKK HFQKVMRQEDVSEIWFEYEGTPLKWH YPIGLLFDLLASSSALPWNITVHFKSFPE KDLLHCPSKDAVEAHFMSCMKEADAL KHKSQVINEMQKKDHKQLWMGLQND RFDQFWAINRKLMEYPPEENGFRYIPFR IYQTTTERPFIQKLFRPVAADGQLHTLG DLLREVCPSAVAPEDGEKRSQVMIHGIE PMLETPLQWLSEHLSYPDNFLHISIVPQ PTD | 262 |
| APG5L | APG5 autophagy 5-like protein isoform 2 [Danio rerio] | NP_991181.1 | MIMADDKDVLRDVWFGRIPACFTLSPD ETTEREAEPYYLLLPRVSYLTLVTDKVK KHFLKVMKAEDVEEMWFEHEGTPLKW HYPIGVLFDLHASNSALPWNVTVHFKN FPEQDLLHCSTNSVIEAHFMSCIKEADA LKHKGQVINDMQKKDHKQLWMGLQN DKFDQFWAMNRKLMEYPTEEGGFRYI PFRIYQTMSDRPFIQTLFRPVSSEGQALT LGDLLKELFPAAIEDEPKKFQVMIHGIE PLLETPIQWLSEHLSHPDNFLHISIIPAPSD | 263 |
| APG5L | PREDICTED: hypothetical protein LOC462905 isoform 2 [Pan troglodytes] | XP_001144782.1 | MTDDKDVLRDVWFGRIPTCFTLYQDEI TEREAEPYYLLLPRVSYLTLVTDKVKK HFQKVMRQEDISEIWFEYEGTPLKWHY PIGLLFDLLASSSALPWNITVHFKSFPEK DLLHCPSKDAIEAHFMSCMKEADALKH KSQVINEMQKKDHKQLWMGLQNDRF DQFWAINRKLMEYPAEENGFRYIPFRIY QTTTERPFIQKLFRPVAADGQLHTLGDL LKEVCPSAIDPEDGEKKNQVMIHGIEPM LETPLQWLSEHLSYPDNFLHISIIPQPTD | 264 |
| APG5L | PREDICTED: similar to Autophagy protein 5-like (APG5-like) (Apoptosis-specific protein) isoform 1 [Canis familiaris] | XP_854294.1 | MTDDKDVLRDVWFGRIPTCFTLYQDEI TEREAEPYYLLLPRVSYLTLVTDKVKK HFQKVMRQEDISEIWFEYEGTPLKWHY PIGLLFDLLASSSALPWNITVHFKSFPEK DLLHCPSKDAIEAHFMSCVKEADALKH KSQVINEMQKKDHKQLWMGLQNDRF DQFWAINRKLMEYPAEENGFRYIPFRIY QTTTERPFIQKLFRPVAADGQLHTLGDL LKEVCPSAIAPEDGEKKNQVMIHGIEPM LETPLQWLSEHLSYPDNFLHISIIPQPTD | 265 |
| APG7 | ATG7 autophagy related 7 homolog [Rattus norvegicus] | NP_001012097.1 | MGDPGLSKLQFAPFNSALDVGFWHELT QKKLNEYRLDEAPKDIKGYYYNGDSA GLPTRLTLEFSAFDMSAPTPARCCPAM GTLHNTNTLEAFKTADKKLLLEQSANEI WEAIKSGAALENPMLLNKFLLLTFADL KKYHFYYWFCCPALCLPESIPLIRGPVG LDQRLSPKQIQALEHAYDDLCRTEGVT ALPYFLFKYDDDTVLVSLLKHYSDFFQ GQRTKLTVGVYDPCNLTQHPGWPLRN FLVLAAHRWSGSFQSVEVLCFRDRTMQ GARDVTHSIIFEVKLPEMAFSPDCPKAV GWEKNQKGGMGPRMVNLSGCMDPKR LAESSVDLNLKLMCWRLVPTLDLDKV VSVKCLLLGAGTLGCNVARTLMGWGV RHVTFVDNAKISYSNPVRQPLYEFEDCL GGGKPKALAAAERLQKIFPGVNASGFN MSIPMPGHPVNFSDVTMEQARRDVEQL EELIDSHDVIFLLMDTRESRWLPTVIAA SKRKLVINAALGFDTFVVMRHGLKKPK QQGAGDLCPSHLVAPADLGSSLFANIP GYKLGCYFCNDVVAPGDSTRDRTLDQ | 266 |

TABLE 2-continued

Full-length sequences of autophagy proteins.

| NO | PRODUCT NAME | NCBI Accession | Sequence | SEQ ID NO |
|---|---|---|---|---|
| | | | QCTVSRPGLAVIAGALAVELMVSVLQH PEGGYAIASSSDDRMNEPPTSLGLVPHQ IRGFLSRFDNVLPVSLAFDKCTACSSKV LDQYEQEGFTFLAKVFNSSHSFLEDLTG LTLLHQETQAAEIWDMSDEETV | |
| APG7 | APG7 autophagy 7-like [Homo sapiens] | NP_006386.1 | MAAATGDPGLSKLQFAPFSSALDVGFW HELTQKKLNEYRLDEAPKDIKGYYYNG DSAGLPARLTLEFSAFDMSAPTPARCCP AIGTLYNTNTLESFKTADKKLLLEQAA NEIWESIKSGTALENPVLLNKFLLLTFA DLKKYHFYYWFCYPALCLPESLPLIQGP VGLDQRFSLKQIEALECAYDNLCQTEG VTALPYFLIKYDENMVLVSLLKHYSDF FQGQRTKITIGVYDPCNLAQYPGWPLR NFLVLAAHRWSSSFQSVEVVCFRDRTM QGARDVAHSIIFEVKLPEMAFSPDCPKA VGWEKNQKGGMGPRMVNLSECMDPK RLAESSVDLNLKLMCWRLVPTLDLDK VVSVKCLLLGAGTLGCNVARTLMGWG VRHITFVDNAKISYSNPVRQPLYEFEDC LGGGKPKALAAADRLQKIFPGVNARGF NMSIPMPGHPVNFSSVTLEQARRDVEQ LEQLIESHDVVFLLMDTRESRWLPAVIA ASKRKLVINAALGFDTFVVMRHGLKKP KQQGAGDLCPNHPVASADLLGSSLFAN IPGYKLGCYFCNDVVAPGDSTRDRTLD QQCTVSRPGLAVIAGALAVELMVSVLQ HPEGGYAIASSSDDRMNEPPTSLGLVPH QIRGFLSRFDNVLPVSLAFDKCTACSSK VLDQYEREGFNFLAKVFNSSHSFLEDLT GLTLLHQETQAAEIWDMSDDETI | 267 |
| APG7L | APG7 autophagy 7-like [Gallus gallus] | NP_001025763.1 | MAAVSNESQNPVDPGSSKLQFAPFSSA LNVGFWHELTQKKLNEYRLDETPKVIK GYYYNGDPSGFPARLTLEYSAFDINASI PARCCPAFGTLYNTNTFETFKSCDKKSL LEKEANEIWESIKSGAALENPMLLNRFL LLTFADLKKYHFYYWFCYPALCFPDGI HVIQKPVCLGDRFSLNQIQALQKAYDE LCQTEGVTAFPYFLIKYHDNSVVVSPLK KWDGFFQDQGGKVTVGVYDPCNLSHY PGWPLRNFLILASHKWGNILQSIEVLCF RDRTMQGVRDITHSIIFEIKLPQGAFGPD CPKAVGWEKNQKGGMGPRVVNLSEC MDPKRLAESSVDLNLKLMCWRLVPTL DLEKIVSAKCLLLGAGTLGCSVARTLM GWGVRKITFVDNARISYSNPVRQPLYE FEDCLSGGKPKALAAAERLQKIFPGVN SEGYNMSIPMPGHPVNFSEVTMAQARK DVATLEELIDAHDVVFLLMDTRESRWL PAVIAASKRKLVINAALGFDTFVVMRH GLKKPKQQETGNACFSTAPGPSDLLGS SLFSNIPGYKLGCYFCNDVVAPGDSTR DRTLDQQCTVSRPGLAMIAGALAVELM VSVLQHPEGGYAVASSSDDRMNEPPTS LGLVPHQIRGFLSRFDNVLPVSLAFDKC TACSPKVLDQYEREGFNFLAKVFNSSH SFLEDLTGLTLLHQETQAAEIWDMSDD ETV | 268 |
| APG7L | AuTophaGy (yeast Atg homolog) family member (atg-7) [Caenorhabditis elegans] | NP_502064.1 | MATFVPFVTCLDTGFWNEVNKKKLND WKLDETPKCISSQLSLHQTEGFKCHLSL SYDSLSSLESTTGLSMSGTLLLYNTIESF KMVDKSDLIRSEAEKIWESITTRKWLQ NPRLLSQFFIIAFADLKKFKYYYWTCVP ALVYPSEIKQEITPLSSLGADHKILFDFY RKNNFPIFLYSKQSSKMLELSELENNTN PDEICVVVADPSPVAYSAGWMVRNVL AAVAHLHPTWKHCHIISLRSADSIGIKY TWTLPSAECSADGAQNAVPKAVGWER NANDKLQPISVDLSKEFDPKILMERSVD LNLSLIKWRLHPDIQLERYSQLKVLILG AGTLGCNIARCLIGWGVRHISFLDNSTV SYNNPVRQSLSEFEDARLGRGKAETAQ | 269 |

TABLE 2-continued

Full-length sequences of autophagy proteins.

| NO | PRODUCT NAME | NCBI Accession | Sequence | SEQ ID NO |
|---|---|---|---|---|
| | | | AAIQRIFPSIQATAHRLTVPMPGHSIDEK DVPELEKDIAKLEQLVKDHDVVFLALD SREARWLPTVLASRHKKIAISVAIGFDT YVIIRHGIGSRSESVSDVSSSDSVPYSQL SCYFCSDVTAPGNSTFDRTLDQQCTVA RPGTSMIASGIAVELLSSVLQYPDPLKT PASHDDNTTVLGAAPHQIRGFLGRFQQI LPSVKRFDQCVACGDAIAAQFQQNGW KFVRDVMNSPGRLEEVTGLDELQNSVN AIDIDFEDDEDF | |
| APG7L | unnamed protein product [Kluyveromyces lactis] | XP_451226.1 | MLNDLKFSPAFKSFVDTSFFHELSRLKL EVFKLDSAEKELFSALDLENITSNTVSL SLRDDSFDPVLNNEAVTLKGSVLNFNTI ESFKSCDVKFIKEKGQQLLEQGLKNG LKECVRFYVISFADLKKYKFYYWVCM PTFQSEGSSYEIISTKSIEDGVKKDIWEQ NSFISCVVDGKIQEASPQYLKVCQKVIF KDFSRLKGIPAAVTKNFLTVWSQISTRN TYTICFLRDDNSSFAAEIRVTGSNTGCL KVSGWEKNGLGKLAPKSADLSSLMDP VKIAEQSIDLNLKLMKWRIAPDIDLERI KNIKALILGSGTLGCYVARALLAWGTR HVTFVDNSTVSFSNPVRQPLFNFEDCGR PKAEAASDSLKKIFPSVVSAGYQLEIPM IGHPVSNESKQRKDYEILDELIRTHDVIF LLMDARETRWLPSVLGRMHEKIVINAA LGFDSYLVMRHGNNNDNLGCYFCNDI VAPSDSLTDRTLDQMCTVTRPGVALLA ASQAVELLVTYLQPSTNVLGSAPHQIR GFLNEFKTVKLETPAYQHCCASNENVIL TLKENGWNFVKQALDDYKCVEQLSGL SKVQEEAELAIQEDISFDDDEELSIE | 270 |
| APG7L | PREDICTED: similar to APG7 autophagy 7-like isoform 3 [Canis familiaris] | XP_849849.1 | MAAALGDPGLSKLLFAPFSSALDVGFW HELTQRKLNEYRLDEAPKDIKGYYYNG DSAGLPARLTLEFSAFDMSAPTPAHCCP AVGTLFNTNTLEAFKAADKKLLLEQAA DEIWEAIKSGAALENPVLLNKFLLLTFA DLKKYHFYYWFCFPALCLPESIPLIQGP VGLDQRFSPKQIQALEHAYDDLCQTEG VPALPYFLIKYDENMVLVSLLKHYSDF FQDQRTKITIGVYDPCNLAQHPGWPLR NLLVLAAHRWSSCFQSVEVLCFRDRTM QGMRDIAHSIIFEVKLPEMAFSPDCPKA VGWEKNQKGGMGPRMVNLSECMDPK RLAESSVDLNLKLMCWRLVPTLDDLEKV VSVKCLLLGAGTLGCNVARTLMGWGV RHITFVDNANISYSNPVRQPLYEFEDCL AGGKPKALAAADRLQKIFPGVNARGFN MSIPMPGHPVNFSSVTLDQARRDVEQL EQLIESHDVVFLLMDTRESRWLPAVIAA SKRKLVINAALGFDTFVVMRHGLKKPK QQGAGDLCSGHLVAPADLLGSSLFANI PGYKLGCYFCNDVVAPGDSTRDRTLD QQCTVSRPGLAMIAGALAVELMVSVL QHPEGGYAIASSSDDRMNEPPTSLGLVP HQIRGFLSRFDNVLPVSLAFDKCTACSS KVLDQYEREGFNFLAKVFNSSHSFLED LTGLTLLHQETQAAEIWDMSDDETV | 271 |
| APG8 | microtubule-associated proteins 1A/1B light chain 3 [Homo sapiens] | NP_073729.1 | MPSEKTFKQRRTFEQRVEDVRLIREQHP TKIPVIIERYKGEKQLPVLDKTKFLVPD HVNMSELIKIIRRRLQLNANQAFFLLVN GHSMVSVSTPISEVYESEKDEDGFLYM VYASQETFGMKLSV | 272 |
| APG8a | microtubule-associated protein 1 light chain 3 alpha [Bos taurus] | NP_001039640.1 | MPSDRPFKQRRSFADRCKEVQQIREQH PSKIPVIIERYKGEKQLPVLDKTKFLVPD HVNMSELVKIIRRRLQLNPTQAFFLLVN QHSMVSVSTPIADIYEQEKDEDGFLYM VYASQETFGF | 273 |

TABLE 2-continued

Full-length sequences of autophagy proteins.

| NO | PRODUCT NAME | NCBI Accession | Sequence | SEQ ID NO |
|---|---|---|---|---|
| APG8a | microtubule-associated protein 1 light chain 3 alpha [*Mus musculus*] | NP_080011.1 | MPSDRPFKQRRSFADRCKEVQQIRDQH PSKIPVIIERYKGEKQLPVLDKTKFLVPD HVNMSELVKIIRRRLQLNPTQAFFLLVN QHSMVSVSTPIADIYEQEKDEDGFLYM VYASQETFGF | 274 |
| APG8a | microtubule-associated protein 1 light chain 3 alpha [*Rattus norvegicus*] | NP_955794.1 | MPSDRPFKQRRSFADRCKEVQQIRDQH PSKIPVIIERYKGEKQLPVLDKTKFLVPD HVNMSELVKIIRRRLQLNPTQAFFLLVN QHSMVSVSTPIADIYEQEKDEDGFLYM VYASQETFGF | 275 |
| APG8a | microtubule-associated protein 1 light chain 3 alpha [*Danio rerio*] | NP_999904.1 | MPSDRPFKQRRSFADRCKEVQQIREQH PNKIPVIIERYKGEKQLPVLDKTKFLVP DHVNMSELVKIIRRRLQLNPTQAFFLLV NQHSMVSVSTPISEIYEQERDEDGFLYM VYASQETFGC | 276 |
| APG8a | PREDICTED: microtubule-associated protein 1 light chain 3 alpha isoform 2 [*Pan troglodytes*] | XP_001159668.1 | MPSDRTFQQRRSFSDRCKEVQQIRDQH PSKIPVIIERYKGEKQLPVLDKTKFLVPD HVNMSELVKIIRRRLQLNPTQAFFLLVN QHSMVSVSTPIADIYEQEKDEDGFLYM VYASQETFGF | 277 |
| APG8b | microtubule-associated proteins 1A/1B light chain 3 [*Gallus gallus*] | NP_001026632.1 | MPSEKSFKQRRTFEQRVEDVRLIRDQH PTKIPVIIERYKGEKQLPVLDKTKFLVPD HVNMSELIKIIRRRLQLNSNQAFFLLVN GHSMVSVSTPISEVYESEKDEDGFLYM VYASQETFGVQSSV | 278 |
| APG8b | microtubule-associated protein 1 light chain 3 beta [*Rattus norvegicus*] | NP_074058.2 | MPSEKTFKQRRSFEQRVEDVRLIREQHP TKIPVIIERYKGEKQLPVLDKTKFLVPD HVNMSELIKIIRRRLQLNANQAFFLLVN GHSMVSVSTPISEVYESERDEDGFLYM VYASQETFGTALAV | 279 |
| APG8b | microtubule-associated protein 1 light chain 3 beta [*Mus musculus*] | NP_080436.1 | MPSEKTFKQRRSFEQRVEDVRLIREQHP TKIPVIIERYKGEKQLPVLDKTKFLVPD HVNMSELIKIIRRRLQLNANQAFFLLVN GHSMVSVSTPISEVYESERDEDGFLYM VYASQETFGTAMAV | 280 |
| APG8b | microtubule-associated protein 1 light chain 3 beta [*Danio rerio*] | NP_955898.1 | MPSEKTFKQRRTFEQRVEDVRLIREQHP NKIPVIIERYKGEKQLPILDKTKFLVPDH VNMSELIKIIRRRLQLNSNQAFFLLVNG HSMVSVSTAISEVYERERDEDGFLYMV YASQETFGFQ | 281 |
| APG8b | PREDICTED: APG16 autophagy 16-like isoform 9 [*Pan troglodytes*] | XP_001150056.1 | MSSGLRAADFPRWKRHISEQLRRRDRL QRQAFEEIILQYNKLLEKSDLHSVLAQK LQAEKHDVPNRHEISPGHDGTWNDNQ LQEMAQLRIKHQEELTELHKKRGELAQ LVIDLNNQMQRKDREMQMNEAKIAEC LQTISDLETECLDLRTKLCDLERANQTL KDEYDALQITFTALEGKLRKTTEENQEL VTRWMAEKAQEANRLNAENEKDSRRR QARLQKELAEAAKEPLPVEQDDDIEVIV DETSDHTEETSPVRAISRAATRRSVSSFP VPQDNVDTHPGSGKEVRVPTTALCVFD AHDGEVNAVQFSPGSRLLATGGMDRR | 282 |

TABLE 2-continued

Full-length sequences of autophagy proteins.

| NO | PRODUCT NAME | NCBI Accession | Sequence | SEQ ID NO |
|---|---|---|---|---|
| | | | VKLWEVFGEKCEFKGSLSGSNAGITSIE FDSAGSYLLAASNDFASRIWTVDDYRL RHTLTGHSGKVLSAKFLLDNARIVSGS HDRTLKLWDLRSKVCIKTVFAGSSCND IVCTEQCVMSGHFDKKIRFWDIRSESIV REMELLGKITALDLNPERTELLSCSRDD LLKVIDLRTNAIKQTFSAPGFKCGSDWT RVVFSPDGSYVAAGSAEGSLYIWSVLT GKVEKVLSKQHSSSINAVAWSPSGSHV VSVDKGCKAVLWAQY | |
| APG8b | PREDICTED: similar to microtubule-associated proteins 1A/1B light chain 3 [*Canis familiaris*] | XP_536756.2 | MPSEKTFKQRRTFEQRVEDVRLIREQHP TKIPVIIERYKGEKQLPVLDKTKFLVPD HVNMSELIKIIRRRLQLNANQAFFLLVN GHSMVSVSTPISEVYESEKDEDGFLYM VYASQETFGMKLFV | 283 |
| APG8c | PREDICTED: microtubule-associated protein 1 light chain 3 gamma [*Pan troglodytes*] | XP_514305.2 | MPPPQKIPSVRPFKQRKSLAIRQEEVAGI RAKFPNKIPVIVERYPRETFLPLLDKTKF LVPQELTMTQFLSIIRSRMVLRATEAFY LLVNNKSLVSMSATMAEIYRDYKDED GFVYMTYASQETFGCLESAAPRDGSSL EDRPCNPL | 284 |
| APG8c | PREDICTED: similar to microtubule-associated protein 1 light chain 3 gamma [*Canis familiaris*] | XP_854448.1 | MQTPQKTQSLRPFKQRKSLATRQEEVA GIRAKFPNKIPVIVERYPREKFLPLLDKT KFLVPQELTMIQFLSIIRSRLVLGATEAF YLLVNNRSLVSMSMTMAEVYRDYKDE DGFVYMTYASQEMFGCLGSEQILPSSP VHVKNQCSNLRRDGSSPVCVVDNPVSE AAPQ | 285 |
| APG9 | APG9 autophagy 9-like 1 [*Homo sapiens*] | NP_001070666.1 | MAQFDTEYQRLEASYSDSPPGEEDLLV HVAEGSKSPWHHIENLDLFFSRVYNLH QKNGFTCMLIGEIFELMQFLFVVAFTTF LVSCVDYDILFANKMVNHSLHPTEPVK VTLPDAFLPAQVCSARIQENGSLITILVI AGVFWIHRLIKFIYNICCYWEIHSFYLH ALRIPMSALPYCTWQEVQARIVQTQKE HQICIHKRELTELDIYHRILRFQNYMVA LVNKSLLPLRFRLPGLGEAVFFTRGLKY NFELILFWGPGSLFLNEWSLKAEYKRG GQRLELAQRLSNRILWIGIANFLLCPLIL IWQILYAFFSYAEVLKREPGALGARCW SLYGRCYLRHFNELEHELQSRLNRGYK PASKYMNCFLSPLLTLLAKNGAFFAGSI LAVLIALTIYDEDVLAVEHVLTTVTLLG VTVTVCRSFIPDQHMVFCPEQLLRVILA HIHYMPDHWQGNAHRSQTRDEFAQLF QYKAVFILEELLSPIVTPLILIFCLRPRAL EIIDFFRNFTVEVVGVGDTCSFAQMDV RQHGHPQWLSAGQTEASVYQQAEDGK TELSLMHFAITNPGWQPPRESTAFLGFL KEQVQRDGAAASLAQGGLLPENALFTS IQSLQSESEPLSLIANVVAGSSCRGPPLP RDLQGSRHRAEVASALRSFSPLQPGQA PTGRAHSTMTGSGVDARTASSGSSVWE GQLQSLVLSEYASTEMSLHALYMHQLH KQQAQAEPERHVWHRRESDESGESAP DEGGEGARAPQSIPRSASYPCAAPRPGA PETTALHGGFQRRYGGITDPGTVPRVPS HFSRLPLGGWAEDGQSASRHPEPVPEE GSEDELPPQVHKV | 286 |

TABLE 2-continued

Full-length sequences of autophagy proteins.

| NO | PRODUCT NAME | NCBI Accession | Sequence | SEQ ID NO |
|---|---|---|---|---|
| APG9L | autophagy-related 9-like 1 [Mus musculus] | NP_001003917.2 | MAQFDTEYQRLEASYSDSPPGEEDLLV HVAEGSKSPWHHIENLDLFFSRVYNLH QKNGFTCMLIGEMFELMQFLFVVAFTT FLVSCVDYDILFANKMVNHSLHPTEPV KVTLPDAFLPAQVCSARIQENGSLITILV IAGVFWIHRLIKFIYNICCYWEIHSFYLH ALRIPMSALPYCTWQEVQARIVQTQKE HQICIHKRELTELDIYHRILRFQNYMVA LVNKSLLPLRFRLPGLGEVVFFTRGLKY NFELILFWGPGSLFLNEWSLKAEYKRG GQRLELAQRLSNRILWIGIANFLLCPLIL IWQILYAFFSYAEVLKREPGALGARCW SLYGRCYLRHFNELEHELQSRLNRGYK PASKYMNCFLSPLLTLLAKNGAFFAGSI LAVLIALTIYDEDVLAVEHVLTTVTLLG VTVTVCRSFIPDQHMVFCPEQLLRVILA HIHYMPDHWQGNAHRSQTRDEFAQLF QYKAVFILEELLSPIVTPLILIFCLRPRAL EIIDFFRNFTVEVVGVGDTCSFAQMDV RQHGHPQWLSGGQTEASVYQQAEDGK TELSLMHFAITNPGWQPPRESTAFLGFL KEQVQRDGAAAGLAQGGLLPENALFTS IQSLQSESEPLSLIANVVAGSSCRGPSLS RDLQGSRHRADVASALRSFSPLQPGAA PQGRVPSTMTGSGVDARTASSGSSVWE GQLQSLVLSEYASTEMSLHALYMHQLH KQQTQAEPERHVWHRRESDESGESAPE EGGEGARAPQPIPRSASYPCATPRPGAP ETTALHGGFQRRYGGITDPGTVPRGPS HFSRLPLGGWAEDGQPASRHPEPVPEE GSEDELPPQVHKV | 287 |
| APG9L | autophagy-related 9A [Rattus norvegicus] | NP_001014240.1 | MAQFDTEYQRLEASYSDSPPGEEDLLV HVAEGSKSPWHHIENLDLFFSRVYNLH QKNGFTCMLIGEIFELMQFLFVVAFTTF LVSCVDYDILFANKMVNHSLHPTEPVK VTLPDAFLPAQVCSARIQENGSLITILVI AGVFWIHRLIKFIYNICCYWEIHSFYLH ALRIPMSALPYCTWQEVQARIVQTQKE HQICIHKRELTELDIYHRILRFQNYMVA LVNKSLLPLRFRLPGLGEVVFFTRGLKY NFELILFWGPGSLFLNEWSLKAEYKRG GQRLELAQRLSNRILWIGIANFLLCPLIL IWQILYAFFSYAEVLKREPGALGARCW SLYGRCYLRHFNELEHELQSRLNRGYK PASKYMNCFLSPLLTLLAKNGAFFAGSI LAVLIALTIYDEDVLAVEHVLTTVTLLG VTVTVCRSFIPDQHMVFCPEQLLRVILA HIHYMPDHWQGNAHRSQTRDEFAQLF QYKAVFILEELLSPIVTPLILIFCLRPRAL EIIDFFRNFTVEVVGVGDTCSFAQMDV RQHGHPQWLSGGQTEASVYQQAEDGK TELSLMHFAITNPGWQPPRESTAFLGFL KEQVQRDGAAAGLAQGGLLPENALFTS IQSLQSESEPLSLIANVVAGSSCRGPPLS RDLQGSRHRADVASALRSFSPLQPGQA PQGRVPSTMTGSGVDARTASSGSSVWE GQLQSLVLSEYASTEMSLHALYMHQLH KQQTQAEPERHVWHRRESDESGESAPE EGGEGARAPQPIPRSASYPCATPRPGAP ETTALHGGFQRRYGGITDPGTVPRAPS HFSRLPLGGWAEDGQPASRHPEPVPEE GSEDELPPQVHKV | 288 |
| APG9L | ATG9 autophagy related 9 homolog A [Bos taurus] | NP_001029878.1 | MAQFDTEYQRLEASYSDSPPGEEDLLV HVPEGSKSPWHHIENLDLFFSRVYNLH QKNGFTCMLIGEIFELMQFLFVVAFTTF LVSCVDYDILFANKMVNHSLHPTEPVK VTLPDAFLPAQVCSARIQENGSLITILVI AGVFWVHRLIKFIYNICCYWEIHSFYLH ALRIPMSALPYCTWQEVQARIVQTQKE HQICIHKRELTELDIYHRILRFQNYMVA LVNKSLLPLRFRLPGLGEVVFFTRGLKY NFELILFWGPGSLFLNEWSLKAEYKRG | 289 |

TABLE 2-continued

Full-length sequences of autophagy proteins.

| NO | PRODUCT NAME | NCBI Accession | Sequence | SEQ ID NO |
|---|---|---|---|---|
| | | | GQRLELAQRLSNRILWIGIANFLLCPLIL IWQILYAFFSYAEVLKREPGALGARCW SLYGRCYLRHFNELEHELQSRLNRGYK PASKYMNCFLSPLLTLLAKNCAFFAGSI LAVLIALTIYDEDVLAVEHVLTTVTLLG VTVTVCRSFIPDQHMVFCPEQLLRVILA HIHYMPDHWQGNAHRSQTRDEFAQLF QYKAVFILEELLSPIVTPLILIFCLRPRAL EIIDFFRNFTVEVVGVGDTCSFAQMDV RQHGHPQWLSGGQTEASVYQQAEDGK TELSLMHFAITNPGWQPPRESTAFLGFL KEQVQRDGAAAGLAQGGLLPENALFTS IQSLQSESEPLSLIANVVAGSSCRGPPLP RDLQGSRHRAEVASALRSFSPLQPGQA PTGRAPSTMTGSGVDARTASSGSSVWE GQLQSLVLSEYASTEMSLHALYMHQLH KQQAQAEPERHVWHRRESDESGESAPE EGGEGARATQPIPRSASYPCAAPRPGAP ETTALQGGFQRRYGGITDPGTVPRAPS HFSRLPLGGWAEDGQSASRHPEPVPEE GSEDELPPQVHKV | |
| APG9L | ATG9 autophagy related 9 homolog A [Gallus gallus] | NP_001029993.1 | MAHLETQYQRLESSSTESPPGGGDLLV HVPEGAKSPWHHIENLDLFFSRVYNLH QKNGFTCMLIGEIFELMQFIFVVAFTTF LISCVDYDILFANKAVNHSQHPSEPIKV TLPDAFLPPNVCSARIQANSFLICILVIA GVFWIHRLVKFIYNICCYWEIHSFYINA LRIPMSNLPYYTWQEVQARIVQIQKEH QICIHKKELTELDIYHRILRFKNYMVAM VNKSLLPIRFRLPLLGDTVFYTRGLKYN FELIFFWGPGSLFENEWSLKAEYKRAG NRLELAEKISTRILWIGIANFLLCPLILIW QILYAFFSYTEILKREPGSLGARCWSLY GRCYLRHFNELDHELQSRLSKGYKPAS KYMNCFISPLLTIVAKNVAFFAGSILAV LIALTIYDEDVLAVEHVLTTVTLLGVGI TVCRSFIPDQHLVFCPEQLLRVILAHIHY MPDHWQGNAHRYETRDEFAQLFQYKA VFILEELLSPIITPLILIICLRPKSLDIVFF RNFTVEVVGVGDTCSFAQMDVRQHGH PAWMSAGKTEASIYQQAEDGKTELSL MHFAITNPKWQPPRESTAFIGFLKERVH RDSSVALAQQAVLPENALFSSIQSLQSE SEPHSLIANVIAGSSVLGFHMGRDGQAS RHLSEVASALRSFSPLQSAQQPSAGFQT GGSSAMTASGADARTMSSGSSAWEGQ LQSMILSEYASTEMSLHALYMHELHKQ HAQLEPERHTWHRRESDESGESTHEEL DAQRGAPVPLPRSASYPFSSRQPAEETA TLQTGFQRRYGGITDPGTVHRAPSHFSR LPLGGWAEDGQSARHPEPVPEESSEDE LPPQIHKV | 290 |
| APG9L | Os01g0200000 [Oryza sativa (japonica cultivar-group)] | NP_001042313.1 | MQVKQKVYELYKGTVERVTGPRTVSA FLDKGVLSVPEFILAGDNLVSKCPTWS WEAGDPSKRKPYLPPDKQFLVTRNVPC LRRAVSLEEEYDAAGAEVVLGDDEDG EGWLATHGVQASKQEEEEDIPSMDTLD IGKTEGIKSIPSYFSAGKKAEEEEDIPDM DTYEDSGNDSVATAQPSYFVAEEPEDD NILRTRTYDVSITYDKYYQTPRVWLTG YDESRMPLKPELVFEDISQDHARKTVTI EDHPHLSAGKHASVHPCKHAAVMKKII DVLMSQGVEPEVDKYLFIFLKFMASVIP TIEYDYTMDFDLGSTSR | 291 |
| APG9L | Os01g0614900 [Oryza sativa (japonica cultivar-group)] | NP_001043569.1 | MAARAEAAAAAPRPLQAAAIGVCAET GFWDALRRLKLDVLGTDDSPIPITGYYT PRQYEKIASLFRICPESILPPSANSFGDR NNCPVPGTLLNTNNMRGFQNLDRALLL KAEAKKILHDIKSGKVEENPALLLRFLV ISFADLKNWKVYYNVAFPSLIFDSKITL LSLKLASQVLKQEEATSLSNAFTEWRK SSETTVVPFFLINISPDSSATIRQLKDWK | 292 |

TABLE 2-continued

Full-length sequences of autophagy proteins.

| NO | PRODUCT NAME | NCBI Accession | Sequence | SEQ ID NO |
|---|---|---|---|---|
| | | | ACQGNGQKLLFGFYDHGNRGFPGWAL RNYIAFVSLRWKIEKVHFFCYREKRGR PDIQQSLVGEASFPAPHAGWDEPDYVP EAIGWEGETAGKESKEMKPKEIDLSSIN PASQDEEKQLMHLKLMGWRHFPVNLD KLAGVRCLLLGAGTLGCEVARLLMTW GVRKLTVVDDGCVSMSDLVKQSLYTD KDCGVPRVTAIVPHLKERCSAVEVEGI QMGIPKLEYNISASKISSITDDCKRLQTL VDSNDVVFLLNETWEGMWLPTLLCAD KNKIAITVLLGYDNYLVMRHGAGPGTK SGGMDEGIAQIENLSTQDALGRQRLGC CFCSDTTSLVNSDHNGALDQQSAVILP GLTSVASGKAVELFARMLHHPDEIHAP GDIAGTDTEHQLGLLPHQMQGSLSKCV LSTVLCNSSSNCIACSNAVLSEYRRRGF DFVTQAITCPTYLKDLTGISDLKKPFAS KISASIPVSKTSASIPVNLEKLSSARCLLL GAGTLGCDVARILMDCGVRKLTVVDS GRVVVSNLARQSLYTSDDRDSPKASAI LGRLKERCPSVDAKGIKMEIPMPGHPV SPNEAVSVLEDCKRLQELVSSHDAVFL LTDTRESRWLPTLLCANENKIAITAALG YDSYLVMRHGAGPGTNCGSPDVVAAA DTLSAEDVLGRQRLGCYFCNDVVAPV DSVSNRTLDQQCTVTRPGLSSITSGCAA DLFTRMLHHPDGIHAPGEIAGTSSEGPL GLLPHQIRGSLSQYNLLTLLGYSSSNCT ACSNAVLSEYHRRGMDFVMQVINEPT YLEDLTGLTDLMKSAAYSQVEWIDEVD DDDEMDI | |
| APG9L | Os01g0681400 [Oryza sativa (japonica cultivar-group)] | NP_001043880.1 | MKAPAAAAAAVGNRAGGVDPSIPRFK CQECHRALVVVGVDSFADKLPAQATS AHASSVHGSIMGASRMDNSYVVLSKQ NKSHGHGIPPRPPSAAAPHIEPNQPTRA MEGSYIVLPPAAASIYKTSTSEGGGAQL PPPSINSSSLLPGNSFHSNVTVLKRAFEI ATSQTQVEQPMCLDCMRLLSDKMDKE IEDVNADIKAYEVCLQHLEQESHTVLSD AGFQKEKLKIEEEEKKLNAAIEEAEKQY SEISSEMKDLEIKSKEFEELEERYWHEF NSFQFQLTSHQEERDAILAKIEVSQVHL ELLKQTNVLNDAFYISHDGVIGTINNFR LGRLPNVQVEWDEINAAWGQAALLLH TMAQYFTPKFEYRIKIHPMGSYPRVTDI HKNTYELFGPVNLFWSTRFDKAMTWF LTCLQDFAEFAISLDKENNVPPEKSLKL PYKIDGDKVGSHTIFLSFNKVENWTKA LKYTLCNLKWVLYWFIGNTSFAPPSGS LCAAQSSKR | 293 |
| APG9L | Os02g0117800 [Oryza sativa (japonica cultivar-group)] | NP_001045690.1 | MAAQRDDEAGWSAEAARRVWGGAVP LQVHLHDADVTTLPPPPPFLTLGPRIGY LPLLVPIIKAHFSSTLPPGIDTVWFEYKG LPLKWYIPIGVLYDLLCADPERPWNLT VHFRGYPSEILTLCDGEDSVKWSYMNS LKEAAFIITGNSKNVMNMSQADQGAL WQSVMKGNLDGYMNISTRLKLGPFEE DCLVRTSSVEGQQGSDEPESPGSGKPCR VPVRLYVRSVQEDLYDLEDALPVGDW ESISYINRPFEVRREEGRSYITLEHALKT LLPEFFSSKASRIPDDSETAPQAPDSAPN DDSDVTPRSCEKLESSASSSPQEANVAN KGKIVKLVRVQGIEVDMDIPFLWVANN LKNPECYLHICVYVGTRKREPKDGR | 294 |
| APG9L | Os03g0248000 [Oryza sativa (japonica cultivar-group)] | NP_001049553.1 | MMSFRSKDRNVQPRFNWPWRSESPLS AQLLIDIPPEIELSDYRRLPGSGSESPSGL LHGEGFKDEPIADLDIFFERLYEYFCAK GLRCIVTKWIIEMLNVLFMVCCIGFFFLI VDWNALGHLKCGVEALESGEKPCDLM QVVKHNPLVPFTFPKMITIGSMVILTTY GLINFLKFFVQLRSTLNIRDFYCNSLKIT DLEIQTISWPKIIEKVVLLQKSQKLCVV | 295 |

TABLE 2-continued

Full-length sequences of autophagy proteins.

| NO | PRODUCT NAME | NCBI Accession | Sequence | SEQ ID NO |
|---|---|---|---|---|
| | | | RDLSEHDIIMRIMRKENYLIGMVNKGIIS FPIRPWVPGAGPTVKSHLQNRRNHLILP KALEWTLNWCIFQSMFDSKFCVRKDFL TSPAVLKKRLVFVGISMLILSPCLVIFPL VYLILRHAEEIYNHPSTASSRRWSNLSR WIFREYNEVDHFFRHRMNNSAVHSLN YLKQFPTPLISIMAKFISFVSGGLAGALII IGFLGESVLEGHIFGRNLFWYTIVFGTIA AISRKVVADELQVIDPEGAMCNVVQQT HYMPKRWRGKEDSEVVRREFETLFQFT IVMLLEEMASIFISPYLLIFEVPKRVDDIL RFISDFTIYVDGVGDVCSLSLFDPRRHG NRNYASPFDALKTLRSSQGKMEKSFLS FQSVYPSWEPNAEGKQFLTNLQKFKEK QIRQQALAQYQAMEASGFVASTRGHR DDIFHQLLPSDIHNRAEAISPAVYNLGP LGLLDTDQRSHPYILDWYYVCHPPHLD RTEAPYFNEVFPETSENTGSAAFKASEI EEARGWDSDMVPPPRADRDEWNFNHE RVRSHMDASTSSNLFHHAPVEHHDTKG NIIDWWDQAPEHSTGQQGSFLEPPEFG NRYVAGNRSSYHSGDVSDGSVEELERS YNRSSSSWRRPQDLSTTRYMDDSDIEE GLNLPFADLPQKEDARHGTSDTNDPT PVGLPVRIIPRSSDPV | |
| APG9L | Os03g0391000 [Oryza sativa (japonica cultivar-group)] | NP_001050279.1 | MKEDESPPHPHRSIPFHPSPPRDGSDSG GSVAAVPPSPRAAAAAAARPPVMTSLP GRGVSPSSSDPLCEGNAAPSSSSSSGQD LKQLKNSILSCVFSSPFSIFEAHQDSSAN RSLKPHSGSYAWSRFLRRIACTGSMWR FLGASKALTSSDVWFLGKCYKLSSEEL SNSSDCESGNAAFLEDFSSRIWITYRKG FDAISDSKYTSDVNWGCMVRSSQMLV AQALIFHHLGRSWRKPSQKPYSPEYIGI LHMFGDSEACAFSIHNLLQAGKSYGLA AGSWVGPYAMCRAWQTLVCTNREHH EAVDGNGNFPMALYVVSGDEDGERGG APVVCIDVAAQLCCDFNKNQSTWSPIL LLVPLVLGLDKLNPRYIPLLKETLTFPQS LGILGGKPGTSTYIAGVQDDRALYLDP HEVQLAVDIAADNLEAGTSSYHCSTVR DLALDLIDPSLAIGFYCRDKDDFDDFCS RASELVDKANGAPLFTVVQSVQPSKQ MYNEESSSGDGMDSINVEGLDGSGETG EEEWQIL | 296 |
| APG9L | Os03g0746600 [Oryza sativa (japonica cultivar-group)] | NP_001051251.1 | MTMVEAEAGKEAIRRALRSLRRRHLVE EGAHRPAIEALARPFAAQAVEWKEKAE KHELELQQCYKAQSRLSEQLVTEIEEGK ASKALLKEKETLITTMQTELEQTREENT QLKQSLEEKTSALDLIIQEHQAVKAELE QALTKQKVAEDENRNLIDRWMLEKMK DAERLNEANAMYEEMVLKLKSAGVGG IQHNALQEADGIIRRSEAGYMDIMETPIP STCRITIRAHDGGCGSIIFQHNTDKLISG GQDQTVKIWSAHTGALTSTLQGCLGSV NDLAVTNDNKFVIAACSSNKLFVWEVN GGRPRHTLTGHTKNVSSVDASWVKSC VLASSSNDHTIKIWDLQSGFCKSTIMSG SNANSLAFIDGVTLCSGHRDGHLRLWD IRSAKCTSQTFAHLDVSSVSVSRNRNFI LTSGKDNVHNLFDPRTMEVCGKFKAM GNRVVSSWGRPCISPDENSIAAGANDG SVYIWSRLKKDGVPTILQGHSSSVVSSS WCGLGPLATADKHHIYIWT | 297 |
| APG9L | Os04g0682000 [Oryza sativa (japonica cultivar-group)] | NP_001054293.1 | MTSLPDRGVSSSSSDPLCEGNIAPCSSSS EQKEDCSLKQSKTSILSCVFNSPFNIFEA HQDSSANKSPKSSSGSYDWSRVLRRIV CSGSMWRFLGTSKVLTSSDVWFLGKC YKLSSEESSSDSDSESGHATFLEDFSSRI WITYRRGFDAISDSKYTSDVNWGCMV RSSQMLVAQALIFHHLGRSWRRPLEKP YNPEYIGILHMFGDSEACAFSIHNLLQA | 298 |

TABLE 2-continued

Full-length sequences of autophagy proteins.

| NO | PRODUCT NAME | NCBI Accession | Sequence | SEQ ID NO |
|---|---|---|---|---|
| | | | GNSYGLAAGSWVGPYAMCRAWQTLV RTNREQHEVVDGNESFPMALYVVSGD EDGERGGAPVVCIDVAAQLCCDFNKG QSTWSPILLLVPLVLGLDKINPRYIPLLK ETFTFPQSLGILGGKPGTSTYIAGVQDD RALYLDPHEVQMAVDIAADNIEADTSS YHCSTVRDLALDLIDPSLAIGFYCRDKD DFDDFCSRATELVDKANGAPLFTVVQS VQPSKQMYNQDDVLGISGDGNINVEDL DASGETGEEEWQIL | |
| APG9L | Autophagy-specific gene 9 CG3615-PA [Drosophila melanogaster] | NP_611114.1 | MSSPHINYRSLAEEAASPFLEHHPSTGQ GPSKTQDAKANAAAAHLDPLGEHGLE QPLDEHDTEHEGEDTPRNSGVMIHMVP ETGRARWNHIEDLDSFFSRMYQYQQK HGFTVIVVDEMLQVLEFGFVVWLLAFV MHCVRFDVLFGDTPPGGLNPNKTTLSD VMYPTGECLANFTWVTYLVVFIAAIYL GIRLLKMVYHITQYADIKRFYNSALHIE DSDLDNFTWHEVQQRIRRVQAEQHMCI DKESLTELDIYHRVLRFKNYLVALMNK QLLPVRFHIPLYGEVVSLSRGMLFNIDFI LFRGPGSPFQNNWQLRDEFAVRSNQTE LAQRLSKLILGVALLNLVLAPVIFVWQL IYFSFSYANILRKEPGALGLRTWSNYGR LYLRHFNELDHELDARLNRAYDYADR YLNSFSSPLAAVIAKNLLFISGGLLLLIL ALGIYEEHVFQVEHLLAILAGLGAIGVV CRTLIPDENLVWCPEQLMTAILAHVHY LPSEWRQQAHTTKVRQEFSNFFQPKAG YLLSEIFSPFVTPFVLIFVFRPKAIELVRF FRTFTVSVRGVGNVCSFAQMDVRKHG NPDWQLTSELEEMTRATAQQPQQEPQQ QSLAGGKTEMSLLRFTLNNPEWQMPK EAKQFLRGVREHAVGELVQAKTSMVQ ENPLTNSLISFGTMGADYCSIANSVLTA QVTPQQLEISQSLRPGLGPVSGGFPVAA SDFRQMLQQNLSASVGPLDSMRRLRLS RAEGRLEGPTDTLLYGLCGVDPRVGST PLNVGVADMCLSALYLHELNQQKRQA RQSRIDEAEDERPGTSHWPPRPPAAPSA DTGFGSRHTVITSKAAESTPLLGSIRS | 299 |
| APG9L | APG9 (AUTOPHAGY 9) [Arabidopsis thaliana] | NP_850164.1 | MMSSGHKGPNVRNFFKWQRGESSSSLT TGLLHNESHEIELSNYGGIPSPGSESPSG LLNGESLNVQPIADLDLFVERLYSYYRD KGLWCIIVKWAVELLSLGPIICFSGFFLL YVDWNGLQNAKCGMDAVESGTKPCD LVKEAIHPHPLSPFTLTTAIIVGYLALFS VYWLFCFLRFFAQLKDTLDFRHFYYNN LHVTDNEILTMPWATVLEKVVQLQSSQ CLCVVKDLSAHDMVRLMRKENYLIG MLNKGLLSFPISHWIPGAGPAVKSAPD GTQYHLVLTKTLEWTLNWCILQSMFDC NFRVRRDFVSNPTTLKKRLFVVGLAML LLSPFLVIFMLVYLFLRHAEQFYNHPST ASSRRWSNLSKWLFREFNEVDHLFKHR INSSVVHASEYLKQFPSPIISIIAKFVSFV SGGFAAVLIIIAFLEESLLEGHIPGRNLF WYAAVFGTITAISRAAISDELLVLDPVG TMSLVVQNTHYMPKRWRGKENKDDV RLELETLFQYTGMMLLEEIASIFITPFLL MFVVPKRVDDILQFIKDFTVDIEGVGH VCSFSAFYFENHGNIKYGSPHNATRRE QRSSQGKMEKSFLSFQSSYPSWESDSLG KQFLSNLRTFRDRKLHEINTRHSSPSRA WRESTNTPALYRDIPRNPLASGNHTDS MWLIDPDQRNHPYLLDWYYTSQAHNR TDHPIERANEILTANQNATDCWPPDLGI RGEDSRDLLNMEASTSGQFFRESILRHD QPEGEDSYGSQHPLDGRNQWWGRGNH SQISTAHPATTNSFIEPPDFINRYTAGNL LDNSWSRRSIEEEDEEEELDWEENAR RNLSRTTFMDDNDIEAGIDLHFDDVYSS RPQETSTSSTTLR | 300 |

TABLE 2-continued

Full-length sequences of autophagy proteins.

| NO | PRODUCT NAME | NCBI Accession | Sequence | SEQ ID NO |
|---|---|---|---|---|
| APG9L | AuTophaGy (yeast Atg homolog) family member (atg-9) [Caenorhabditis elegans] | NP_872184.1 | MAETQNLLQKIDNSSINLIFFQKKTHQM FNSQSKRAYQQIDDDFDDEVLRNSTCT SRFMQGWGSSTRSLLFGGASNDEQRNL IASSSSHHSYHDSPAEEPPETHYEQFTAT HNHGPPTMASSSQLNSRRWDHVLNLD EFFTHIYEYHQNGGYLCIVLQKVFSLLQ FIFVMSFTTFFTQCVNYQFLFANTNVTS HGTVNQGKRHFGDAVVDNCPAHISIW MIFAILAAIVYWITRVIKHAQYIMKMSE IQQFYAHELKIADDQLPNLTWHAIVKRI CEAQKKLRLSIHQDNITSIYIYHRILRYK NYMTGMINKRILHPVFDVPFLGPIAYLP NNLKHEIERILFTSSTSAWTNGPNLREE YKHHEQLDMAAKKMKEDVINLFLQILR ISVARPDASTAPIPDYGIVLLTDGAHKK TTRWAWNEKIQYLLRHFNELDHELSAR LNRSHIYAAAYMDQFFSPVLEIAAKNIT FIAAAVFGVLTILSAWDEDVLQVEHVIT VLTICGIVVLVCRGMIPDENLVWQPEIL MTHVTSELHYLPSTWKGKAHTTGVRH EFDQLFQMKWMFFVLELTSPIFTPFVLL FWLRPRCSQLANFFHDYTERVDGLGDV CSFAVMDVGKHGDPKWNHIKELKAIV EDQEDQQQAQSVVTSLNRARDGKTELS ILHFKTTNPEWQPPKASEKFLRKFRNRL GQEASMLAPLTSMHLGQQMDRQQQQ GKIGKK | 301 |
| APG9L | ADR071Wp [Ashbya gossypii ATCC 10895] | NP_984167.1 | MEQSEDTIQHERKNTFLSRVFGVHSSEV GDSIETAELSQYPIQIARSGSNAIDESRVI ESDQASSSEEEDTDGHDLSVAENMTSY NGAQGSGSEDSDVPFSDQELETIETYTI AKVGQGSSSEDDRLQADSAEEEDALLF QHRLQDGSKGRNKVSSQPLGLKRILGS KGKSILGKEPASQEDSFIFRKGPTWDEE NQLRPESKRPGLLSGKSNARLSSPSRPS PLSARERALWKWANVENLDGFLQDVY SYYLGNGFYCIMIEKILNLLTLLFIVFIST YMSHCIDYSKLPNGHKFSDVRVDQCYE TQITGTTKLLFWIFGVFVVLKVVQMYF DFRRIHEIHNFYTYLLNISDKELQTIPWQ SVIHQIMRLKDQNAVTANVVEVKAKN HIDAHDVANRIMRKENYLIALYNKDIL HLSLPIPLYRTSTLTKTLEWNIHLCIIGFA FNEAGFLKQSFLNPAQREFLSEELKKRF ILAGFLNIILAPFLVVYFVLLYFFRYFNE YKTSPGSLSTRQYTPIAEWKFREYNELY HLFKKRMGLSYEVANTYINQFPNALGD YFFKFVKFISGSFVAILALMTVLDPENF LNFELTADRTVLFYMTVLGTIWAVCHS AVNDNCSVFDPEDSLKELITYIHYAPKE WDGRYHTDEVKQEFCKLYNLRVILLLR ELASLIMTPFILWFSLPNSAESIVDFFRE VTVYGDGLGYVCKYAMFDENCKKGLR TNKHLQGTQTKYGHSLGDDHDSSDEET DKGMNKMIQSYMYFVDDYQNSVNAV GKYQIPKTQNLSHESKYNMKSHQHYS WKKQFKLGSKPEDFKIGSVTPRALSSSI LANKPKSNLRARLDPEISHSNVQFDDL GESFINSIPVADYDPIERSDAMGGNGVL GLLNQYYRKSDVGR | 302 |
| APG9L | PREDICTED: hypothetical protein isoform 3 [Pan troglodytes] | XP_001161225.1 | MAQFDTEYQRLEASYSDSPPGEEDLLV HVAEGSKSPWHHIENLDLFFSRVYNLH QKNGFTCMLIGEIFELMQFLFVVAFTTF LVSCVDYDILFANKMVNHSLHPTEPVK VTLPDAFLPAQVCSARIQENGSLITILVI AGVFWIHRLIKFIYNICCYWEIHSFYLH ALRIPMSALPYCTWQEVQARIVQTQKE HQICIHKRELTELDIYHRILRFQNYMVA LVNKSLLPLRFRLPGLGEAVFFTRGLKY NFELILFWGPGSLFLNEWSLKAEYKRG GQRLELAQRLSNRILWIGIANFLLCPLIL IWQILYAFFSYAEVLKREPGALGARCW | 303 |

TABLE 2-continued

Full-length sequences of autophagy proteins.

| NO | PRODUCT NAME | NCBI Accession | Sequence | SEQ ID NO |
|---|---|---|---|---|
| | | | SLYGRCYLRHFNELEHELQSRLNRGYK PASKYMNCFLSPLLTLLAKNGAFFAGSI LAVLIALTIYDEDVLAVEHVLTTVTLLG VTVTVCRSFIPDQHMVFCPEQLLRVILA HIHYMPDHWQGNAHRSQTRDEFAQLF QYKAVFILEELLSPIVTPLILIFCLRPRAL EIIDFFRNFTVEVVGVGDTCSFAQMDV RQHGHPQWLSAGQTEASVYQQAEDGK TELSLMHFAITNPGWQPPRESTAFLGFL KEQVQRDGAAASLAQGGLLPENALFTS IQSLQSESEPLSLIANVVAGSSCRGPPLP RDLQGSRHRAEVASALRSFSPLQPGQA PTGRAHSTMTGSGVDARTASSGSSVWE GQLQSLVLSEYASTEMSLHALYMHQLH KQQAQAEPERHVWHRRESDESGESAP DEGGEGARAPQSIPRSASYPCAAPRPGA PETTALHGGFQRRYGGITDPGTVPRALS HFSRLPLGGWAEDGQSASRHPEPVPEE GSEDELPPQVHKV | |
| APG9L | AGAP001762-PA [Anopheles gambiae str. PEST] | XP_321322.4 | MTTSRQFDAKTYDTLTNQDTNPFADKR SPTIEEEDTPQVIHVVPETSKARWNHIE DLDSFFTRVYIYHQKHGFYVMMLQKLF ELFQFVFVVVLITYMFNCIDYAILFRDKI IDQESKVSLGDAMIGVSECAANLGAFQ WMALVLAGLFWTFRLFKFFYQFFQFW DIKMFYNTALKIEDADLDNLTWHEVQK CIREVQSEIQMSINKEQLTELDIYHRILR FKNYMVAMMNKSLLPATTKLPLLGNV VLMSQALRYNIGLILFWGPWSPFENSW HLREEYKRPSMRNELAAKLSKQILWVA IANFILSPPIFICQLMYFFFNYADLIKKEP GTLGVRCWSQYGKLYLRHFNELDHEL DARLTRAYRPAVKYMNSFSSPLLTVIA RNIAFDAGGVASLILLLAIYDEDVFQVQ HVLTLFTILGMISVIARSLIPDENMVWC PEQLLRNVLAHVHYLPSVWRGHAHSS VVRDQFELFFQLKIMYILNELFSPLVAP FVLLYDLRPKSQQLVDFFRNFTVDVVG VGDVCSFAQMDVRKHGNPDWQIPVVA DDKDMRPAGAGAGAAAAQYNQGEHG KTELSLVHFTLTNPTWQMPPEAKQFVQ GIKRHALHDLNRQRGMMLGLHNPTAM GQSLLSVESMGAEYSSIIQPILQTHNLSN SQHLGLSMHLGGGGFGSPVPPMTPGYG PAGMMPSTVQQQQQQQPTAQHGGAG VQSSHQYHFGPQSYDFERMLQQNLTD ASTVAPNMPARSTFLADIHENDDESAG APPALMPELEEGSRYAAPYATDGMVYS TRGGMSRREGPAGGSRTGLLSSLYGEL PTNVPAPYEFTTADMCLSTLYLHELHH NHLRRHGGSLRLDMGSPPPPPSSGSSQR PTTTATFSSRFMGPGGIRPSRSMGGSAA AERTPLLGSKKS | 304 |
| APG9L | unnamed protein product [Kluyveromyces lactis] | XP_452931.1 | MTDSQDKVNGGSKNTFLSRVFGVHSSA VENSLDAAEMSHITMPTEQDFSNYAED EGNVRLIESDQEPSSSNEDSNDEEPLIQQ PQSIRFDTASDGMATIQSESEPDEGGTE EDEVHLEEEDFSDQDLASSVSKYGQPSS SEDEEPLSNRDSNRGSDETIPFIGRQRLN LGGKNPITGATKSTKNPSESRVFERLLG NSPAKMFRNNGRPNNLEESFLFRKPSV AEQSGPGKSTHFNLKPPPIFNNISTLTST SKNSLSSLSPKERALWKWANIENLDTF LQQVYEYYLGNGFYCIITEKVIHLATILF VVFISTYMGHCIDYSRLSSSHTFEEIHIE QCYKTQISPTAKVFLWIFYAFIGLKVLQ LYFDVKALKDIRNFYNYLLSISDKDLQT IPWQSVIQQLVLLKDQNAITANATEVK AKNRLSAHDVANRIMRKENFVIALYDN NILDLSLPVPLLRTCALTKTLEWNINLCI LGFAFNEKGYLKQAFLRESQREYLGEE LKKRFVLAGFLNIILSPFLVTYFVLLNFF RYFNEYKTSPGSIGSRQYTPIAEWKFRE | 305 |

TABLE 2-continued

Full-length sequences of autophagy proteins.

| NO | PRODUCT NAME | NCBI Accession | Sequence | SEQ ID NO |
|---|---|---|---|---|
| | | | YNELYHIFQKRMRLSMIIADNYVNQFP NTLLSLTLSFIQFVSGSFVAILGILTIFDP DNFLNFEITPDRTVLFYMTVFGTLWAV CHSSINDEYTVLKPEETLEELVSYTHYA PKEWKGKYHTEDIKNEFCRLYNLRITLL LRELVSIIITPFILWFSLPKNSERIIDFFRE CTVYEEGLGYVCKYAMFEATKIDKGT KAKKQTKRMFSQAEQDDSETESDEGV NKMLQSYMYFVDDYKNAGNAVGKNQ LPASPIEPSYHPYSSTKDYSWKTQFALG KNSNRKRNLNRSRVKRFPDRSSDLELG SLSGSLINKSTLFKDDIADNADELKAGN GVMGLLNQYYKKSDRNR | |
| APG9L | PREDICTED: similar to Autophagy protein 9-like 1 (APG9-like 1) isoform 2 [Canis familiaris] | XP_536074.2 | MAQFDTEYQRLEASYSDSPPGEEDLLV HVPEGSKSPWHHIENLDLFFSRVYNLH QKNGFTCMLIGEVFELMQFLFVVAFTT FLVSCVDYDILFANKMVNHSLHPTEPV KVTLPDAFLPAQVCSARIQENGSLITILV IAGVFWIHRLIKFIYNICCYWEIHSFYLH ALRIPMSALPYCTWQEVQARIVQTQKE HQICIHKRELTELDIYHRILRFQNYMVA LVNKSLLPLRFRLPGLGEAVFFTRGLKY NFELILFWGPGSLFLNEWSLKAEYKRG GQRLELAQRLSNRILWIGIANFLLCPLIL IWQILYAFFSYAEVLKREPGALGARCW SLYGRCYLRHFNELEHELQSRLNRGYK PASKYMNCFLSPLLTLLAKNGAFFAGSI LAVLIALTIYDEDVLAVEHVLTTVTLLG VTVTVCRSFIPDQHMVFCPEQLLRVILA HIHYMPDHWQGNAHRSQTRDEFAQLF QYKAVFILEELLSPIVTPLILIFCLRPRAL EIIDFFRNFTVEVVGVGDTCSFAQMDV RQHGHPQWLSGGQTEASVYQQAEDGK TELSLMHFAITNPGWQPPRESTAFLGFL KEQVQRDGAAAGLAQGGLLPENALFTS IQSLQSESEPLSLIANVVAGSSCRGPPLP RDLQGSRHRAEVASALRSFSPLHPGQV PAGRAPSTMTGSGVDARTASSGSSVWE GQLQSLVLSEYASTEMSLHALYMHQLH KQQAQAEPERHVWHRRESDESGESAPE EGGEGSRASQPIPRSASYPCAAPRPGAP ETTALQGGFQRRYGGITDPGTVPRAPS HFSRLPLGGWAEDGQSASRHPEPVPEE GSEDELPPQVHKV | 306 |
| APG9L | PREDICTED: similar to autophagy protein 9 [Danio rerio] | XP_695180.2 | MAHFDTEYQRLEASYSDSPPGEENLLV HVPEGSKSPWHHIENLDLFFQRVYNLH QKNGFTCMLLGEIFELVQLVFVVAFTV FLANCVDYDILFANKFVNHTDSLKVTL PDAFLPVDVCSARIRDSVPVIFILVISGV FWLHRLVKFIYNICCYWEIRSFYINALKI SMADLPYFTWQEVQARIVEIQKEHQICI HKKELSELDIYHRILRFKNYMVAMVNK SLLPVRFRLPVLGDTVFYTRGLKYNFEL IFFWGPGSLFENEWSLKSEYKRGGNRL ELADRLSSRILWIGIANLLLCPVILIWQIL YAFFSYTEVIKREPGSLGARCWSLYGRF YLRHFNELDHELMSRLSKGYKASSKY MNCFMSPLLTVVAKNVAFFAGSILAVL IALTIYDEDVLAVEHVLSSITLLGVCITV CRSFIPDKHMVFCPEQLLKVILAHIHYM PDHWQGNAHRYETRDEFAQLFQYKAV FILEELLSPVITPFILIFCLRRKSLEIIDFFR NFTVDVVGVGDTCSFAQMDVRQHGHP AWMSAGKTEASIYQQAEDGKTELSLM HFAITNPHWQPPRESTHFISLLKEKVHR DAAVGQQGIIAENAGFTSTHSLHNDSEP RSLIANLLMGPPSLASLHLGREGSINHV SIGVSEGASALRSLSPVSTSLHRGSYPS ARLPRSDHPAVVAGRGMAGSGTDARTI SSGSSAWEGQLTSMILSEYASTEMSIHA LYMHEMHKQQSRGELSRHTWHRQESD ESSESVNEDVEAARNFPRSSTFPCTTTS | 307 |

TABLE 2-continued

Full-length sequences of autophagy proteins.

| NO | PRODUCT NAME | NCBI Accession | Sequence | SEQ ID NO |
|---|---|---|---|---|
| | | | HQEGAAAQQSGSQRRQGGTSDPSSGSF RVQRTPRMAMGGWSEENQTSRHHDPV PEEGSEDELPPHIHKVT | |
| BECN1 | beclin 1 [Gallus gallus] | NP_001006332.1 | MEGGRAPACTTQVSFVCQRCSQPLKLD TSFKILDRLTIQELTAPPLTAAPARPGDA QEESALSEEAFTEGRQDGVSRRFIPPAR MMSTESANSFTLIGEASDGGTMENLSR RLKVTGDLFDIMSGQTDVDHPLCEECT DTLLDQLDTQLNITENECQNYKRCLEIL EKMNEDDKEKLQTELKELALEEEQLIQ ELEDVEKNRKIVAEDFERVRAEAERLE QEEAQYQKEYCEFKRQQLELDDDELKSV ENQMRYAQMQLDKLKKTNVFNATFHI WHSGQFGTINNFRLGRLPSVPVEWNEI NAAWGQTVLLLHALANKMGLKFQRY RLVPYGNHSYLESLTDKSKELPLYCSG GLRFFWDNKFDHAMVAFLDCVQQFKE EVEKGETRFCLPYRMDVEKGKIEDTGG SGGSYSIKTQFNSEEQWTKALKFMLTN LKWGLAWVSSQFYNK | 308 |
| BECN1 | beclin 1 [Bos taurus] | NP_001028799.1 | MEGSKTSSSTMQVSFVCQRCSQPLKLD TSFKILDRVTIQELTAPLLATAQLKPGET QEEEANSGEEPFIETRQDGVSRRFIPPAR MMSTESANSFTLIGEASDGGTMENLSR RLKVTGDLFDIMSGQTDVDHPLCEECT DTLLDQLDTQLNVTENECQNYKRCLEI LEQMNEDDSEQLGLELKELALEEERLIQ ELEDVEKNRKIVAENLEKVQAEAERLD QEEAQYQREYSEFKRQQLELDDDELKSV ENQMRYAQMQLDKLKKTNVFNATFHI WHSGQFGTINNFRLGRLPSVPVEWNEI NAAWGQTVLLLHALANKMGLKFQRY RLVPYGNHSYLESLTDKSKELPLYCSG GLRFFWDNKFDHAMVAFLDCVQQFKE EVEKGETRFCLPYRMDVEKGKIEDTGG SGGSYSIKTQFNSEEQWTKALKFMLTN LKWGLAWVSSQFYNK | 309 |
| BECN1 | beclin 1 [Rattus norvegicus] | NP_001029289.1 | MEGSKASSSTMQVSFVCQRCSQPLKLD TSFKILDRVTIQELTAPLLTTAQAKPGES QEEEANSGEEPFIETRQDGVSRRFIPPAR MMSTESANSFTLIGEASDGGTMENLSR RLKVTGDLFDIMSGQTDVDHPLCEECT DTLLDQLDTQLNVTENECQNYKRCLE MLEQMNEGDSEQLRELKELALEEERL IQELEDVEKNRKVVAENLEKVQAEAER LDQEEAQYQREYSEFKRQQLELDDELK SVENQMRYAQMQLDKLKKTNVFNATF HIWHSGQFGTINNFRLGRLPSAPVEWN EINAAWGQTVLLLHALANKMGLKFQR YRLVPYGNHSYLESLTDKSKELPLYCS GGLRFFWDNKFDHAMVAFLDCVQQFK EEVEKGETRFCLPYRMDVEKGKIEDTG GSGGSYSIKTQFNSEEQWTKALKFMLT NLKWGLAWVSSQFYNK | 310 |
| BECN1 | beclin 1 [Homo sapiens] | NP_003757.1 | MEGSKTSNNSTMQVSFVCQRCSQPLKL DTSFKILDRVTIQELTAPLLTTAQAKPG ETQEEETNSGEEPFIETPRQDGVSRRFIP PARMMSTESANSFTLIGEASDGGTMEN LSRRLKVTGDLFDIMSGQTDVDHPLCE ECTDTLLDQLDTQLNVTENECQNYKRC LEILEQMNEDDSEQLQMELKELALEEE RLIQELEDVEKNRKIVAENLEKVQAEA ERLDQEEAQYQREYSEFKRQQLELDDE LKSVENQMRYAQTQLDKLKKTNVFNA TFHIWHSGQFGTINNFRLGRLPSVPVEW NEINAAWGQTVLLLHALANKMGLKFQ RYRLVPYGNHSYLESLTDKSKELPLYC SGGLRFFWDNKFDHAMVAFLDCVQQF KEEVEKGETRFCLPYRMDVEKGKIEDT GGSGGSYSIKTQFNSEEQWTKALKFML TNLKWGLAWVSSQFYNK | 311 |

TABLE 2-continued

Full-length sequences of autophagy proteins.

| NO | PRODUCT NAME | NCBI Accession | Sequence | SEQ ID NO |
|---|---|---|---|---|
| BECN1 | beclin 1 [Mus musculus] | NP_062530.2 | MEGSKASSSTMQVSFVCQRCSQPLKLD TSFKILDRVTIQELTAPLLTTAQAKPGET QEEEANSGEEPFIETRQDGVSRRFIPPAR MMSTESANSFTLIGEASDGGTMENLSR RLKVTGDLFDIMSGQTDVDHPLCEECT DTLLDQLDTQLNVTENECQNYKRCLEI LEQMNEDDSEQLQRELKELALEEERLIQ ELEDVEKNRKVVAENLEKVQAEAERL DQEEAQYQREYSEFKRQQLELDDELKS VENQVRYAQIQLDKLKKTNVFNATFHI WHSGQFGTINNFRLGRLPSVPVEWNEI NAAWGQTVLLLHALANKMGLKFQRY RLVPYGNHSYLESLTDKSKELPLYCSG GLRFFWDNKFDHAMVAFLDCVQQFKE EVEKGETRFCLPYRMDVEKGKIEDTGG SGGSYSIKTQFNSEEQWTKALKFMLTN LKWGLAWVSSQFYNK | 312 |
| BECN1 | ACR154Wp [Ashbya gossypii ATCC 10895] | NP_983556.1 | MSTPSFKCQNCQCPIDMDLSLMDLSIA QRDMIVNSGGEPTNPSTFKIPPERLSRL HQVRRPHELTVAAAPGAAESYVFLQV NEDGLNRSKHAIEEESGEEEEDDSSKTL SSNIQVLTNIFNILSSKGNIDYPVCHVCC ELMMQRLKAEYADAIRKRDAYFEFMD RLQKQHEKESAQEPKPASAEADLLAQK DELVTKLVALEHENDKLDKEIESLEQQ LREKEQQETRAVLKQNLKDLEHIAFMK DMQSLKNQYELTLNNLDKLRKTNIFNE TFRISHSGPFGTINDLRLGGFSQVRVPW QEINAAMGQLILLLATIAAKIHYELDGY RLKPLGSYSKVERFDPHTQRWNVYNA YSNDDFKIGKLFHKETSLDKALEAIIAIV DQIAKRISTLSRDHNDGGMELPYSMQK DKINGIPIKLLGSDPTLEWTTSCKFLLTN AKWLLAFSSQVT | 313 |
| BECN1 | PREDICTED: beclin 1 isoform 2 [Pan troglodytes] | XP_001160461.1 | MEGSKTSNNSTMQVSFVCQRCSQPLKL DTSFKILDRVTIQELTAPLLTTAQAKPG ETQEEETNSGEEPFIETPRQDGVSRRFIP PARMMSTESANSFTLIGEASDGGTMEN LSRRLKVTGDLFDIMSGQTDVDHPLCE ECTDTLLDQLDTQLNVTENECQNYKRC LEILEQMNEDDSEQLQMELKELALEEE RLIQELEDVEKNRKTVAENLEKVQAEA ERLDQEEAQYQREYSEFKRQQLELDDE LKSVENQMRYAQTQLDKLKKTNVFNA TFHIWHSGQFGTINNFRLGRLPSVPVEW NEINAAWGQTVLLLHALANKMGLKFQ RYRLVPYGNHSYLESLTDKSKELPLYC SGGLRFFWDNKFDHAMVAFLDCVQQF KEEVEKGETRFCLPYRMDVEKGKIEDT GGSGGSYSIKTQFNSEEQWTKALKFML TNLKWGLAWVSSQFYNK | 314 |
| | autophagy-related 4C-like [Danio rerio] | NP_001002103.1 | METKGTDEVETLKSKFMSAWHSVKYS WALKSKTAFSRNSPVFLLGKCYHFKVV DDENPTESTAEALDDDVVTGNVDEFRK DFTSRVWLTYREEFPALPGSSFTSDCG WGCTLRAGQMILAQALLLHILGRDWK WSEALSLEPLDTETWTSSAARRLVATL EASIQGERAQASQPLCPVQGEAEEADS YLKETYHRTIVSWFGDGPSAQLGIYKL VELGMTSGKQAGDWYGPAVVAHILRK AVDEAVDAMLKGIRVYVAQDCTVYSA DVIDSHSTRTESHSDPQGLDSGASPDSR AVVILIPVRLGGEKINPEYLNFVKSILSL EYCIGIIGGKPKQAYYFVGFQDDSLIYM DPHYCQSFVDVSTSDFPLQSFHCPSPKK MSFSKMDPSCTIGFYSKSVEHFEKIANE LSKILQPSSKEKYPAFTIMKGHGKDYEL SIAVEKREWPFIRDARKAGTTSGDFVLL | 315 |

TABLE 2-continued

Full-length sequences of autophagy proteins.

| NO | PRODUCT NAME | NCBI Accession | Sequence | SEQ ID NO |
|---|---|---|---|---|
| | microtubule-associated protein 1 light chain 3 gamma [Homo sapiens] | NP_001004343.1 | MPPPQKIPSVRPFKQRKSLAIRQEEVAGI RAKFPNKIPVVVERYPRETFLPPLDKTK FLVPQELTMTQFLSIIRSRMVLRATEAF YLLVNNKSLVSMSATMAEIYRDYKDE DGFVYMTYASQETFGCLESAAPRDGSS LEDRPCNPL | 316 |
| | hypothetical protein SPAC3A12.01c [Schizosaccharomyces pombe 972h-] | NP_001018232.1 | MQYLCQRCHSLINFKDVYDDDLLKLK NLPKSRFVQASSLTEMNESGESDDQMN SSSEDYPAQRLQLYKKTISEGDYNFDN VPPPELRTPTLDSFVVLPAAKDGYEEEK NSPEEVNDLFSWKIEIYNRIFDLLSSKTK VDHPLCVECAELLTEEMSKTLRALKEE KKMYFNYDNFLSSQTVHEENTAALDSE IDELMKQINEKEEKIEEISDETDKLQKLL RELDEEKEKVYAEEQEFYNNLNQFQIK KLSLERQYDCANLEFEHNSRKLEKLQK MNVFSDIFYISHYSEPNGEGSIATINGLR LGRLPSQKVNWAEINAAWGMTVLLLD VLTEKLDFHSSSYQLKPFGSQSFIIRFDR DPNGNQVKPTKLDLFSSGELKIFMNRR FDQGMVAFLDYLHQFGDFCAAKTPSA VLPYAIENDRIGGKCIRLAFNQDENWTR ALKFVLTDIKFLEAYVSSQDKQSNF | 317 |
| | APG4 (ATG4) autophagy-related homolog B [Rattus norvegicus] | NP_001020882.1 | MDNTVVMEEIRRLCRASLPCAGAAALS MESERHCNGLPAGAEVTNRPLAWRPL VLLIPLRLGLTDINEAYVETLKHCFMMP QSLGVIGGKPNSAHYFIGYVGEELIYLD PHTTQPAVELTDSCFIPDESFHCQHPPC RMGIGELDPSIAVGFFCKTEEDFNDWC QQVKKLSQLGGALPMFELVEQQPSHLA CQDVLNLSLDSSDVERLERFFDSEDEDF EILSL | 318 |
| | Transmembrane protein involved in formation of Cvt and autophagic vesicles; cycles between the pre-autophagosomal structure and other cytosolic punctate structures, not found in autophagosomes; Atg9p [Saccharomyces cerevisiae] | NP_010132.1 | MERDEYQLPNSHGKNTFLSRIFGLQSDE VNPSLNSQEMSNFPLPDIERGSSLLHST NDSREDVDENDLRVPESDQGTSTEEED EVDEEQVQAYAPQISDGLDGDHQLNSV TSKENVLETEKSNLERLVEGSTDDSVPK VGQLSSEEEEDNEFINNDGFDDDTPLFQ KSKIHEFSSKKSNTIEDGKRPLFFRHILQ NNRPQRDTQKLFTSSNAIHHDKDKSAN NGPRNINGNQKHGTKYFGSATQPRFTG SPLNNTNRFTKLFPLRKPNLLSNISVLN NTPEDRINTLSVKERALWKWANVENL DIFLQDVYNYYLGNGFYCIILEKILNICT LLFVVFVSTYMGHCVDYSKLPTSHRVS DIIIDKCYSNSITGFTKFFLWMFYFFVIL KIVQLYFDVQKLSELQNFYKYLLNISDD ELQTLPWQNVIQQLMYLKDQNAMTAN VVEVKAKNRIDAHDVANRIMRRENYLI ALYNSDILNLSLPIPLFRTNVLTKTLEW NINLCVMGFVFNESGFIKQSILKPSQREF TREELQKRFMLAGFLNIILAPFLVTYFV LLYFFRYFNEYKTSPGSIGARQYTPIAE WKFREYNELYIHFKKRISLSTTLANKYV DQFPKEKTNLFLKFVSFICGSFVAILAFL TVFDPENFLNFEITSDRSVIFYITILGAIW SVSRNTITQEYHVFDPEETLKELYEYTH YLPKEWEGRYHKEEIKLEFCKLYNLRIV ILLRELTSLMITPFVLWFSLPSSAGRIVD FFRENSEYVDGLGYVCKYAMFNMKNI DGEDTHSMDEDSLTKKIAVNGSHTLNS KRRSKFTAEDHSDKDLANNKMLQSYV YFMDDYSNSENLTGKYQLPAKKGYPN NEGDSFLNNKYSWRKQFQPGQKPELFR IGKHALGPGHNISPAIYSTRNPGKNWD NNNNGDDIKNGTNNATAKNDDNNGNN DHEYVLTESFLDSGAFPNHDVIDHNKM LNSNYNGNGILNKGGVLGLVKEYYKK SDVGR | 319 |

TABLE 2-continued

Full-length sequences of autophagy proteins.

| NO | PRODUCT NAME | NCBI Accession | Sequence | SEQ ID NO |
|---|---|---|---|---|
| | Autophagy-related protein and dual specificity member of the E1 family of ubiquitin-activating enzymes; mediates the conjugation of Atg12p with Atg5p and Atg8p with phosphatidylethanolamine, required steps in autophagosome formation; Atg7p [Saccharomyces cerevisiae] | NP_012041.1 | MSSERVLSYAPAFKSFLDTSFFQELSRL KLDVLKLDSTCQPLTVNLDLHNIPKSA DQVPLFLTNRSFEKHNNKRTNEVPLQG SIFNFNVLDEFKNLDKQLFLHQRALEC WEDGIKDINKCVSFVIISFADLKKYRFY YWLGVPCFQRPSSTVLHVRPEPSLKGLF SKCQKWFDVNYSKWVCILDADDEIVN YDKCIIRKTKVLAIRDTSTMENVPSALT KNFLSVLQYDVPDLIDFKLLIIRQNEGSF ALNATFASIDPQSSSSNPDMKVSGWER NVQGKLAPRVVDLSSLLDPLKIADQSV DLNLKLMKWRILPDLNLDIIKNTKVLLL GAGTLGCYVSRALIAWGVRKITFVDNG TVSYSNPVRQALYNFEDCGKPKAELAA ASLKRIFPLMDATGVKLSIPMIGHKLVN EEAQHKDFDRLRALIKEHDIIFLLVDSR ESRWLPSLLSNIENKTVINAALGFDSYL VMRHGNRDEQSSKQLGCYFCHDVVAP TDSLTDRTLDQMCTVTRPGVAMMASS LAVELMTSLLQTKYSGSETTVLGDIPHQ IRGFLHNFSILKLETPAYEHCPACSPKVI EAFTDLGWEFVKKALEHPLYLEEISGLS VIKQEVERLGNDVFEWEDDESDEIA | 320 |
| | Subunit of phosphatidylinositol (PtdIns) 3-kinase complexes I and II; Complex I is essential in autophagy and Complex II is required for vacuolar protein sorting; ortholog of the higher eukaryotic gene Beclin 1; Vps30p [Saccharomyces cerevisiae] | NP_015205.1 | MKCQTCHLPLQLDPSLEGLSLTQRNLL LSNNSIITATNENVISNKGIEAADNCGPQ IPKERLRRLGEIQNIKDLNLKDDKLITDS FVFLNHDDDDNANITSNSREDQRYGNA NGNDNKKANSDTSDGTSTFRDHDEEEQ EATDEDENQQIQLNSKTLSTQVNAMTN VFNILSSQTNIDFPICQDCCNILINRLKSE YDDAIKERDTYAQFLSKLESQNKEISES NKEKQYSHNLSEKENLKKEEERLLDQL LRLEMTDDDLDGELVRLQEKKVQLEN EKLQKLSDQNLMDLNNIQFNKNLQSLK LQYELSLNQLDKLRKINIFNATFKISHSG PFATINGLRLGSIPESVVPWKEINAALG QLILLLATINKNLKINLVDYELQPMGSF SKIKKRMVNSVEYNNSTTNAPGDWLIL PVYYDENFNLGRIFRKETKFDKSLETTL EIISEITRQLSTIASSYSSQTLTTSQDESS MNNANDVENSTSILELPYIMNKDKING LSVKLHGSSPNLEWTTAMKFLLTNVK WLLAFSSNLLSKSITLSPTVNYNDKTIS GN | 321 |
| | APG4 autophagy 4 homolog B isoform a [Homo sapiens] | NP_037457.3 | MDAATLTYDTLRFAEFEDFPETSEPVWI LGRKYSIFTEKDEILSDVASRLWFTYRK NFPAIGGTGPTSDTGWGCMLRCGQMIF AQALVCRHLGRDWRWTQRKRQPDSYF SVLNAFIDRKDSYYSIHQIAQMGVGEG KSIGQWYGPNTVAQVLKKLAVFDTWS SLAVHIAMDNTVVMEEIRRLCRTSVPC AGATAFPADSDRHCNGFPAGAEVTNRP SPWRPLVLLIPLRLGLTDINEAYVETLK HCFMMPQSLGVIGGKPNSAHYFIGYVG EELIYLDPHTTQPAVEPTDGCFIPDESFH CQHPPCRMSIAELDPSIAVGFFCKTEDD FNDWCQQVKKLSLLGGALPMFELVEL QPSHLACPDVLNLSLDSSDVERLERFFD SEDEDFEILSL | 322 |
| | AGP7 [Mus musculus] | NP_083111.1 | MGDPGLAKLQFAPFNSALDVGFWHEL TQKKLNEYRLDEAPKDIKGYYYNGDSA GLPTRLTLEFSAFDMSASTPAHCCPAM GTLHNTNTLEAFKTADKKLLLEQSANEI WEAIKSGAALENPMLLNKFLLLTFADL KKYHFYYWFCCPALCLPESIPLIRGPVS LDQRLSPKQIQALEHAYDDLCRAEGVT | 323 |

TABLE 2-continued

Full-length sequences of autophagy proteins.

| NO | PRODUCT NAME | NCBI Accession | Sequence | SEQ ID NO |
|---|---|---|---|---|
| | | | ALPYFLPKYDDDTVLVSLLKHYSDFFQ GQRTKITVGVYDPCNLAQYPGWPLRNF LVLAAHRWSGSFQSVEVLCFRDRTMQ GARDVTHSIIFEVKLPEMAFSPDCPKAV GWEKNQKGGMGPRMVNLSGCMDPKR LAESSVDLNLKLMCWRLVPTLDLDKV VSVKCLLLGAGTLGCNVARTLMGWGV RHVTFVDNAKISYSNPVRQPLYEFEDCL GGGKPKALAAAERLQKIFPGVNARGFN MSIPMPGHPVNFSDVTMEQARRDVEQL EQLIDNHDVIFLLMDTRESRWLPTVIAA SKRKLVINAALGFDTFVVMRHGLKKPK QQGAGDLCPSHLVAPADLGSSLFANIP GYKLGCYFCNDVVAPGDSTRDRTLDQ QCTVSRPGLAVIAGALAVELMVSVLQH PEGGYAIASSSDDRMNEPPTSLGLVPHQ IRGFLSRFDNVLPVSLAFDKCTACSPKV LDQYEREGFTFLAKVFNSSHSFLEDLTG LTLLHQETQAAEIWDMSDEETV | |
| | APG16 autophagy 16-like isoform 1 [Homo sapiens] | NP_110430.5 | MSSGLRAADFPRWKRHISEQLRRRDRL QRQAFEEIILQYNKLLEKSDLHSVLAQK LQAEKHDVPNRHEISPGHDGTWNDNQ LQEMAQLRIKHQEELTELHKKRGELAQ LVIDLNNQMQRKDREMQMNEAKIAEC LQTISDLETECLDLRTKLCDLERANQTL KDEYDALQITFTALEGKLRKTTEENQEL VTRWMAEKAQEANRLNAENEKDSRRR QARLQKELAEAAKEPLPVEQDDDIEVIV DETSDHTEETSPVRAISRAATKRLSQPA GGLLDSITNIFGRRSVSSFPVPQDNVDT HPGSGKEVRVPATALCVFDAHDGEVN AVQFSPGSRLLATGGMDRRVKLWEVF GEKCEFKGSLSGSNAGITSIEFDSAGSYL LAASNDFASRIWTVDDYRLRHTLTGHS GKVLSAKFLLDNARIVSGSHDRTLKLW DLRSKVCIKTVFAGSSCNDIVCTEQCV MSGHFDKKIRFWDIRSESIVREMELLGK ITALDLNPERTELLSCSRDDLLKVIDLRT NAIKQTFSAPGFKCGSDWTRVVFSPDG SYVAAGSAEGSLYIWSVLTGKVEKVLS KQHSSSINAVAWSPSGSHVVSVDKGCK AVLWAQY | 324 |
| | APG10 autophagy 10-like [Homo sapiens] | NP_113670.1 | MEEDEFIGEKTFQRYCAEFIKHSQQIGD SWEWRPSKDCSDGYMCKIHFQIKNGSV MSHLGASTHGQTCLPMEEAFELPLDDC EVIETAAASEVIKYEYHVLYSCSYQVPV LYFRASFLDGRPLTLKDIWEGVHECYK MRLLQGPWDTITQQEHPILGQPFFVLHP CKTNEFMTPVLKNSQKINKNVNYITSW LSIVGPVVGLNLPLSYAKATSQDERNVP | 325 |
| | microtubule-associated protein 1 light chain 3 alpha isoform a [Homo sapiens] | NP_115903.1 | MPSDRPFKQRRSFADRCKEVQQIRDQH PSKIPVIIERYKGEKQLPVLDKTKFLVPD HVNMSELVKIIRRRLQLNPTQAFFLLVN QHSMVSVSTPIADIYEQEKDEDGFLYM VYASQETFGF | 326 |
| | APG4 autophagy 4 homolog C isoform 7 [Homo sapiens] | NP_116241.2 | MEATGTDEVDKLKTKFISAWNNMKYS WVLKTKTYFSRNSPVLLLGKCYHFKYE DEDKTLPAESGCTIEDHVIAGNVEEFRK DFISRIWLTYREEFPQIEGSALTTDCGW GCTLRTGQMLLAQGLILHFLGRAWTW PDALNIENSDSESWTSHTVKKFTASFEA SLSGEREFKTPTISLKETIGKYSDDHEM RNEVYHRKIISWFGDSPLALFGLHQLIE YGKKSGKKAGDWYGPAVVAHILRKAV EEARHPDLQGITIYVAQDCTVYNSDVID KQSASMTSDNADDKAVIILVPVRLGGE RTNTDYLEFVKGILSLEYCVGIIGGKPK QSYYFAGFQDDSLIYMDPHYCQSFVDV SIKDFPLETFHCPSPKKMSFRKMDPSCTI | 327 |

TABLE 2-continued

Full-length sequences of autophagy proteins.

| NO | PRODUCT NAME | NCBI Accession | Sequence | SEQ ID NO |
|---|---|---|---|---|
| | | | GFYCRNVQDFKRASEEITKMLKFSSKE KYPLFTFVNGHSRDYDFTSTTTNEEDLF SEDEKKQLKRFSTEEFVLL | |
| | APG4 autophagy 4 homolog D [Homo sapiens] | NP_116274.3 | MNSVSPAAAQYRSSSPEDARRRPEARR PRGPRGPDPNGLGPSGASGPALGSPGA GPSEPDEVDKFKAKFLTAWNNVKYGW VVKSRTSFSKISSIHLCGRRYRFEGEGDI QRFQRDFVSRLWLTYRRDFPPLPGGCL TSDCGWGCMLRSGQMMLAQGLLLHFL PRDWTWAEGMGLGPPELSGSASPSRYH GPARWMPPRWAQGAPELEQERRHRQI VSWFADHPRAPFGLHRLVELGQSSGKK AGDWYGPSLVAHILRKAVESCSDVTRL VVYVSQDCTVYKADVARLVARPDPTA EWKSVVILVPVRLGGETLNPVYVPCVK ELLRCELCLGIMGGKPRHSLYFIGYQDD FLLYLDPHYCQPTVDVSQADFPLESFHC TSPRKMAFAKMDPSCTVGFYAGDRKE FETLCSELTRVLSSSSATERYPMFTLAE GHAQDHSLDDLCSQLAQPTLRLPRTGR LLRAKRPSSEDFVFL | 328 |
| | autophagy 4b (APG4b) [Arabidopsis thaliana] | NP_191554.1 | MKAICDRFVPSKCSSSSTSEKRDISSPTS LVSDSASSDNKSNLTLCSDVVASSSPVS QLCREASTSGHNPVCTTHSSWTVILKT ASMASGAIRRFQDRVLGPSRTGISSSTS EIWLLGVCYKISEGESSEEADAGRVLAA FRQDFSSLILMTYRRGFEPIGDTTYTSD VNWGCMLRSGQMLFAQALLFQRLGRS WRKKDSEPADEKYLEILELFGDTEASAF SIHNLILAGESYGLAAGSWVGPYAVCR SWESLARKNKEETDDKHKSFSMAVHIV SGSEDGERGGAPILCIEDVTKTCLEFSE GETEWPPILLLVPLVLGLDRVNPRYIPSL IATFTFPQSLGILGGKPGASTYIVGVQED KGFYLDPHDVQQVVTVKKENQDVDTS SYHCNTLRYVPLESLDPSLALGFYCQH KDDFDDFCIRATKLAGDSNGAPLFTVT QSHRRNDCGIAETSSSTETSTEISGEEHE DDWQLL | 329 |
| | APG5/ATG5 (AUTOPH AGY 5); transporter [Arabidopsis thaliana] | NP_197231.1 | MAKEAVKYVWEGAIPLQIHLHKSDVAS HPAPPPALVLAPRIGYLPLLIPLIKPYFK DSLPPGEDSIWFDYKGFPLKWYIPTGVL FDLLCAEPERPWNLTIHFRGYPCNILIPC EGEDSVKWNFVNSLKEAQYIINGNCKN VMNMSQSDQEDLWTSVMNGDLDAYT RLSPKLKMGTVEDEFSRKTSLSSPQSQQ VVPETEVAGQVKTARIPVRLYVRSLNK DFENLEDVPEIDTWDDISYLNRPVEFLK EEGKCFTLRDAIKSLLPEFMGDRAQTSG EERSIDDTEEADGSREMGEIKLVRIQGIE MKLEIPFSWVVNNLMNPEFYLHISVLV KAPQR | 330 |
| | nucleotide binding [Arabidopsis thaliana] | NP_199834.2 | MVQEEKAMEAINDALRALRKRHLLEE GAHAPAISALSKPLISQGSEWKEKTEKL ETELQQCYKAQSRLSEQLVIEVAESRTS KAILQEKELLINDLQKELTQRREDCTRL QEELEEKTKTVDVLIAENLEIRSQLEEM TSRVQKAETENKMLIDRWMLQKMQDA ERLNEANDLYEEMLAKLKANGLETLA RQQVDGIVRRNEDGTDHFVESTIPSTCA NRIHAHEGGCGSIVFEYNSGTLFTGGQD RAVKMWDTNSGTLIKSLYGSLGNILDM AVTHDNKSVIAATSSNNLFVWDVSSGR VRHTLTGHTDKVCAVDVSKFSSRHVVS AAYDRTIKLWDLHKGYCTNTVLFTSNC NAICLSIDGLTVFSGHMDGNLRLWDIQT GKLLSEVAGHSSAVTSVSLSRNGNRILT SGRDNVHNVFDTRTLEICGTLRASGNR LASNWSRSCISPDDDYVAAGSADGSVH VWSLSKGNIVSILKEQTSPILCCSWSGIG KPLASADKNGYVCTWT | 331 |

TABLE 2-continued

Full-length sequences of autophagy proteins.

| NO | PRODUCT NAME | NCBI Accession | Sequence | SEQ ID NO |
|---|---|---|---|---|
| | autophagy-related cysteine endopeptidase 2 isoform a [Homo sapiens] | NP_443168.2 | MESVLSKYEDQITIFTDYLEEYPDTDEL VWILGKQHLLKTEKSKLLSDISARLWFT YRRKFSPIGGTGPSSDAGWGCMLRCGQ MMLAQALICRHLGRDWSWEKQKEQPK EYQRILQCFLDRKDCCYSIHQMAQMGV GEGKSIGEWFGPNTVAQVLKKLALFDE WNSLAVYVSMDNTVVIEDIKKMCRVL PLSADTAGDRPPDSLTASNQSKGTSAY CSAWKPLLLIVPLRLGINQINPVYVDAF KECFKMPQSLGALGGKPNNAYYFIGFL GDELIFLDPHTTQTFVDTEENGTVNDQT FHCLQSPQRMNILNLDPSVALGFFCKEE KDFDNWCSLVQKEILKENLRMFELVQK HPSHWPPFVPPAKPEVTTTGAEFIDSTE QLEEFDLEEDFEILSV | 332 |
| | AuTophaGy (yeast Atg homolog) family member (atg-5) [Caenorhabditis elegans] | NP_490885.2 | MDYEVCRKVWESHVPCQFTLQSSGGT HGEPLPFYTMLPRFSYLALAIQKVLSSF NRRDDGEKVHSDKMWLEHNGIPLKMY IPIGVIYDQANLSENDSILEIIVRTSQPPP QFQMVDRDMMEAMFMQNIKEADYLK TKAEITKNMMKDESAQLWRSVCNNNF DEFWTIVQKLMETSEGNEFAHIPLRVY VKNQAFKQALITAKHPDGSLRTIGEAVS DVLSSSSSSTDSQSEHPPRLISHGIDIPH HTPLIFAAKNLSYPDNFIHVVLLLVVP | 333 |
| | AuTophaGy (yeast Atg homolog) family member (atg-3) [Caenorhabditis elegans] | NP_500024.1 | MQNLVNNLKSAALQIGETFTPVLRESK FRETGVLTPEEYVAAGDHLVHHCPTW KWAGASDPSKIRTFLPIDKQFLITRNVP CHKRCKQMEYDEKLEKIINEEDGEYQT SDETGWVDTHHYEKEHEKNEEKEQST APPPAAPEDSDDDEEPLDLDELGLDD DEEDPNRFVVEKKPLAAGNDNSGEVEK VRTYDLHICYDKYYQVPRLFLMGYDE NRRPLTVEQTYEDFSADHSNKTITVEAH PSVDLTMPTVHPCKHAEMMKRLINQY AESGKVLGVHEYLFLFLKFVQAVIPTIE YDYTRAIKL | 334 |
| | BEClin (human autophagy) homolog family member (bec-1) [Caenorhabditis elegans] | NP_500844.1 | MTTQRSHICLNCQHPLRLDFTQRRPDS ADSEKKSETVITEALTGHSRNLMKLISD AQFPSDAPVCNDCSDALRNEMDAQVA TLDDEIKTYQTYINYLKENHPTTSIPDLK AKLQNVSDEEKELEQQLKKLLAEEEQL DLDLQTKRRTAEAASEKSGELWKKYR DNLRQVFEDQDELHSLEAERQYAEVQH RKLTDTNVLDLCFHIWVDGIVGEINGFR LGYLKDAPVEFTEINAALGQIVLLLEILL ERIGVQHHELMPVAMGSHSYIKLRRNG IDMETYALYGQGTPLSGSSGIDPGIRRF LQLLEFLLKELKDRNKNFKPPYQIHADS LVDNGVKYNAVMTLNTDVRWTRAMA LMLTDLKAACAQCDALRSPI | 335 |
| | LC3, GABARAP and GATE-16 family member (lgg-2) [Caenorhabditis elegans] | NP_502035.1 | MSGNRGGSYISGIVPSFKERRPFHERQK DVEEIRSQQPNKVPVIIERFDGERSLPLM DRCKFLVPEHITVAELMSIVRRRLQLHP QQAFFLLVNERSMVSNSMSMSNLYSQE RDPDGFVYMVYTSQPAFG | 336 |
| | AuTophaGy (yeast Atg homolog) family member (atg-4.2) [Caenorhabditis elegans] | NP_502208.1 | MNNIPDDFKKIASSSRLPRKYCSSESSLS DDDGHEIEHVLKHGAPEEALTPDTERM VVLGQDVVQSAPASLVPGGNLSWMSK IKSAGASMMGSIRPSSSSQDVHSTGEIE KHSKKKWKARLWSTWNNIKYSSTWM SDRSDEYGGENDVVFLGRRYSTSVDES GLRSGFENFCSDYYSRLWITYRTDFPAL LDTDTTTDCGWGCMIRTTQMMVAQAI MVNRFGRDWRFTRRKRSHVAAHGDED DFDREKIQEWMILKLFEDKPTAPLGIHK | 337 |

TABLE 2-continued

Full-length sequences of autophagy proteins.

| NO | PRODUCT NAME | NCBI Accession | Sequence | SEQ ID NO |
|---|---|---|---|---|
| | | | MVGIAAMGKGKKAVGSWYSPSEAVFI MKKALTESSSPLTGNTAMLLSIDGRVHI RDIEVETKNWMKKLILVIVVRLGAAEL NPIYVPHLMRLFAMESCLGITGGRPDHS SWFVGYYGDQIIYLDPHVAHEYIPIDINP NTNVVDSDSKKAKKCPEKSYHCRLLSK MHFFDMDPSCALCFQFESREQFDNDMR QLNLSQFIDIDQGEEHGMKRVRDPMFS VVYGERRQPPSYEREVSETEQAQADKH GFEML | |
| | AuTophaGy (yeast Atg homolog) family member (atg-16.1) [Caenorhabditis elegans] | NP_508768.1 | MQTRSIDNVVNWSRCVHPSCVAWVIFI HFCFAKNCSILYFVLFQFTFFAELMADS YRKLIIERLEDVKQRNKQTATLYNNYS KLAEQLEKKHKYGTSSSNSSQLETGEL ARVKEEMAELYRSKCQNDQRLIDANH RIADFEKKSSAIIAEKIALEATAKSICAK YAKTEVELQRLKVDNDQLNDERIASNT TVTMLTKQIQDIENDRIHFLNKIRELNE QRVDFLNAEVALEEKRRNSRIQDMITS AVQDITDKDTKLEEMLRAMPDTNSNG DLLLGDSVPSRAEFVLECEEGEVNDVH WLDGETFATGGSDRNIKIWKVDGHGG YTRIGTLAGSNAAFTRIDYERDRKHFIA SSNDKNVRIWNLDNSRLLSTLSGHSDQ VTCVKFYQSHSAVSGSADRVIKIWDIQ NQRCSRSLFPASKVLDVATNMGASPSL FASGHFDKKLRFYDGRSTDPVRTVDM GGRITSLDVTMSGCELLVSTRDDTISLID LRTFQTVHCYSAENYRTSSDLSRVVLSS GNEYVAAGSSNGSIFVWNRNSTKLEKQ LCSNSENAIFSLSWNPTGYGLLSSSKQK FVTLWK | 338 |
| | autophagy protein Apg6 family [Arabidopsis thaliana] | NP_567116.1 | MRKEEIPDKSRTIPIDPNLPKWVCQNCH HSLTIVGVDSYAGKFFNDPPPSATQGSS IHGANSVLGSTRMDNSFVVLPRHKPPQ SQGIPPRPRGASSPQPDATQSGKAMEES FVVVYKSEPVSDSGGSHNLSLEVGQNG PLHSNTSGFNATINVLTRAFDIARTQTQ VEQPLCLECMRVLSDKLEKEVEDVTRD VEAYEACVQRLEGETQDVLSEADFLKE KKKIEEEERKLVAAIEETEKQNAEVNH QLKELEFKGNRFNELEDRYWQEFNNFQ FQLIAHQEERDAILAKIEVSQAHLELLN KTNVLIDAFPIRNDGEFGTINNFRLGRLP AIKVEWDEINAAWGQACLLLHTMCNY FRPKFQCQVKIQPMGSYPRIVDSNNETY ELFGPVNLFWSTRYDKAMTLYLMCLK DFADFANSKDQENNIPPDNCLNLPYKIE KDKVLGYSITQSFNKQESWTKALKYTL CNLKWALYWFVGNTNFQPLSATVSLPS NISAAGSLYAKRGPDSSKPSCKKT | 339 |
| | APG7 (AUTOPHAGY 7) [Arabidopsis thaliana] | NP_568652.1 | MAEKETPAIILQFAPLNSSVDEGFWHSF SSLKLDKLGIDDSPISITGFYGPCGHPQV SNHLTLLSESLPLDEQSLIASTSHGNRN KCPVPGILYNTNTVESFNKLDKQSLLK AEANKIWEDIQSGKALEDPSVLPRFLVI SFADLKKWSFRYWFAFPAFVLDPPVSLI ELKPASEYFSSEEAESVSAACNDWRDS DLTTDVPFFLVSVSSDSKASIRHLKDLE ACQGDHQKLLFGFYDPCHLPSNPGWPL RNYLALIRSRWNLETVWFFCYRESRGF ADLNLSLVGQASITLSSGESAETVPNSV GWELNKGKRVPRSISLANSMDPTRLAV SAVDLNLKLMRWRALPSLNLNVLSSV KCLLLGAGTLGCQVARTLMGWGIRNIT FVDYGKVAMSNPVRQSLYNFEDCLGR GEFKAVAAVKSLKQIFPAMETSGVVM AIPMPGHPISSQEEDSVLGDCKRLSELIE SHDAVFLLTDTRESRWLPSLLCANANK IAINAALGFDSYMVMRHGAGPTSLSDD MQNLDINKTNTQRLGCYFCNDVVAPQ DSMTDRTLDQQCTVTRPGLAPIAGALA | 340 |

TABLE 2-continued

Full-length sequences of autophagy proteins.

| NO | PRODUCT NAME | NCBI Accession | Sequence | SEQ ID NO |
|---|---|---|---|---|
| | | | VELLVGVLQHPLGINAKGDNSSLSNTG NNDDSPLGILPHQIRGSVSQFSQITLLGQ ASNSCTACSETVISEYRERGNSFILEAIN HPTYLEDLTGLTELKKAANSFNLDWED DDTDDDDVAVDL | |
| | autophagy 3 (APG3) [Arabidopsis thaliana] | NP_568934.1 | MVLSQKLHEAFKGTVERITGPRTISAFK EKGVLSVSEFVLAGDNLVSKCPTWSWE SGDASKRKPYLPSDKQFLITRNVPCLRR AASVAEDYEAAGGEVLVDDEDNDGWL ATHGKPKDKGKEEDNLPSMDALDINEK NTIQSIPTYFGGEEDDDIPDMEEFDEAD NVVENDPATLQSTYLVAHEPDDDNILR TRTYDLSITYDKYYQTPRVWLTGYDES RMLLQPELVMEDVSQDHARKTVTIEDH PHLPGKHASVHPCRHGAVMKKIIDVLM SRGVEPEVDKYLFLFLKFMASVIPTIEY DYTMDFDLGSSST | 341 |
| | Autophagy-specific gene 5 CG1643-PA [Drosophila melanogaster] | NP_572390.1 | MAHDREVLRMIWEGQIGICFQADRDEI VGIKPEPFYLMISRLSYLPLVTDKVRKY FSRYISAEHQDGAVWFDFNGTPLRLHY PIGVLYDLLHPEEDSTPWCLTIHFSKFPE DMLVKLNSKELLESHYMSCLKEADVL KHRGLVISAMQKKDHNQLWLGLVNEK FDQFWAVNRRLMEPYGDLESFKNIPLRI YTDDDFTYTQKLISPISVGGQKKSLADL MAELSTPVRRAVGCRTHGIDLHEETQL QWMSEHLSYPDNFLHLSVDYKDV | 342 |
| | ubiquitin-like conjugating enzyme [Schizosaccharomyces pombe 972h-] | NP_596084.1 | MFVGKALQFQSFHSSIDATFWHQLSNY KVEKQKLDASPLTIHGKFNTYSRGNISI VFGEAPSNSNIKDCLAEGTLLNANTPQE FTNADVKKIREEIGEVLLNSIKNGVVSE RPNELLRFLIFSYADIKAYKYHYWCLFP SFKETPHWIVKDLSPAESLIPSGPILSQIR EFLSTADYYQRPFFLLIKSTLDEWTIAPL KELSHCVDKSLQFYLVAEDSVQLAEYP SWPVRNILAFAFIKFKLKVINLFLYRDGI NSDTLSKSILIKVEADKDMILEAPLSIVG WERNGKGVLGPRVVNLSTVLDPFVLSE SASTLNLSLMRWRLVPQLDLDRIQNSK CLLLGAGTLGCGVARNLLSWGVRHVT FVDYSTVSYSNPVRQSLFTFEDCKRKLP KAECAAQRLKEIYPNMFSTGYNISIPML GHPIYEAGIEKTMHDYETLENLISTHDA IFLLTDTRESRWLPTVISTAMDKLLINSA LGFDSWLVMRHGSVLQKENRLGCYFC NDIFAPSNSLVDRTLDQTCTVTRSGCAN IATAIAVELFVSLLQHPNGHAAPVLNED QTVLGELPHQIRGFLHNFSLMKISGMA YPQCSACSECIINEWNREKWMFVLRAI NEPDYVEELCGLREVQALGEIAGTMEE WISDKESVIL | 343 |
| | autophagy associated protein Atg9 (predicted) [Schizosaccharomyces pombe] | NP_596247.1 | MFYQPAQNKKQYDDLADIEAQNNVPN TQEVLEAWQESLDSDEDESSPLEESNGF TISEHDDFVKSVPRKNNPTDLLYSGKLL DSDEPPSVHGNSSKVPSKHPSPSFPETTS LRNLQNGSKQKPALPNFNDPHFYNEDV TRSGHPNRSIYTQLPRNEFSNARVLWN RLSARDRVLWRWANVENLDSFLQQVY TYYTGKGLSCIIVHRLFQILTVSFVIGFT TFITSCIDWPAVTPHGSLAGVTKSQCIA QMSPITYLVLWLFLSFLLALWIYYLTDI PRLWQMREFYIHALKIATADMPTVSWQ RVLYRLLKLKNVNALTAEDGRVVSLH NMKRLDAYAIANRIMRKDNYFIALINN GIINIELPLLHRRILTHTTEWNINWCIFNF VFDEQGQLRSAFRNPNSRKRLSEELRR RFIVAGFLNCLFAPIVAIYLVIHNFFRYF NEYHKNPGALSTRRYTPLALWTFREYN ELQHFFDERINDSYAAASHYVSQFPDFN MIRLFKYISFILGSFTAILVIITVFDPELM VTFEITKDRSVLFYLGLFGSLIAVSRSIIP | 344 |

TABLE 2-continued

Full-length sequences of autophagy proteins.

| NO | PRODUCT NAME | NCBI Accession | Sequence | SEQ ID NO |
|---|---|---|---|---|
| | | | DETLVFAPEKALRRVITFTHYMPGWWS DNMHSKAVQQEFCSLYSYRIVNLLWEI LGILLTPVLLFFTFPSCSQDIVDFFREHTI NVEGVGYVCSYAVFQDNPPYESVASLV QSRKISPLIQNKPELSRISFYEQFNTEAP RRDLR | |
| | Autophagy-specific gene 4 CG4428-PA [Drosophila melanogaster] | NP_608563.1 | MLVGLSDQLARIMESVFEAYLGPDSVL ASAVGQAVGSGEPEDIPRRNTDVWVLG KKYNAIQELELIRRDIQSRLWCTYRHGF SPLGEVQLTTDKGWGCMLRCGQMVLA QALIDLHLGRDWFWTPDCRDATYLKIV NRFEDVRNSFYSIHQIAMGESQNKAV GEWLGPNTVAQILKKLVRFDDWSSLAI HVAMDSTVVLDDVYASCREGGSWKPL LLIIPLRLGITDINPLYVPALKRCLELDSS CGMIGGRPNQALYFLGYVDDEVLYLDP HTTQRTGAVAQKTAAAEQDYDETYHQ KHAARLNFSAMDPSLAVCFLCKTSDSF ESLLTKLKEEVLSLCSPALFEISQTRAVD WDTTEDIDWPTMPDIDWPAGTSDSDSF AIVEESGRDSDAGCSGAIGSGKKPSERA VI | 345 |
| | Autophagy-specific gene 7 CG5489-PA, isoform A [Drosophila melanogaster] | NP_611350.1 | MSTEKEIILQFAPWESFVSPTFWHKLAE LKLDHDRLSDSKRSITGHYTNRNASGC LLEVDYTAYNRMAKPPKFSHSAIGTIY NKNTIEEFKALDKLQLLADEGKELLAD MCSGGALRDPSLLTRFFVLSFADLKCH SYYYWFAFPCPLTPTLKLQGAVQKLRD LPNSSSYIMALKALPTESQNFFILYANV EKNIFEARSLSSLDDKNVEFCYFGFADP SEYEHPAWIMRNYAAFLLQQCPSFVGK PLKFLGLRHNQQMNIDDSLVWKVIQTE ACDLSQSENIKFVGWELNKNGKMGPR MVCMRDSMDPAKLAENSVNLNLKLM KWRLVPDLNLEIISQTKCLLFGAGTLGC AVARNLLSWGFKHITLLDSGKVGFSNP VRQNLYTHADAVAGNRMKATTAAQR LKEINPSAETAGYVLEIPMPGHTIGESLL AQTKEHLKVIEKLVQDHDVIFLLTDSRE SRWLPTLLGAAKEKIVINAALGFDSYLV MRHGTTRKEAGDDGQEIEGLKCINGDQ LGCYFCNDVTAPGNSLKDRTLDQQCTV TRPGVSNIAASYAVELLVALLQHPRKEL APAYYAQSGRGRSEETEEKVPEGLLGIL PHSIRGMLCNYENILPATQKFAQCIACS AAVLNEYKKEGHAFLFKTFETAKFLED LTGISEFKRLNSEIIDFDDEEFDMSDSDED | 346 |
| | Autophagy-specific gene 6 CG5429-PA [Drosophila melanogaster] | NP_651209.1 | MSEAEKQAVSFACQRCLQPIVLDEQLE KISVHAMAELSLPIYGDNGNTLDPQDA SSFDHFVPPYRLTDSINGTGFMLVSDGR DNKKMSAAFKLKAELFDCLSSNSEIDH PLCEECADSMLEIMDRELRIAEDEWDV YKAYLDELEQQRVAPNVEALDKELDEL KRSEQQLLSELKELKKEEQSLNDAIAEE EQEREELHEQEESYWREYTKHRRELML TEDDKRSLECQIAYSKQQLDKLRDTNIF NITFHIWHAGHFGTINNFRLGRLPSVSV DWSEINAAWGQTVLLLSALARKIGLTF ERYRVVPFGNHSYVEVLGENRELPLYG SGGFKFFWDTKFDAAMVAFLDCLTQF QKEVEKRDTEFLLPYKMEKGKIIDPSTG NSYSIKIQFNSEEQWTKALKFMLTNLK WGLAWVSSQFVSP | 347 |
| | CG31033 CG31033-PC, isoform C [Drosophila melanogaster] | NP_733313.2 | MSTEEHVWRAHVVRRLRERNRKECDN FKEIIEQNNRLIDHVAQLKADNLKISVE NEQLRNAVSTGGTGSNVAIATLEKKLL SQQEELTELHKRKGENSQMIVDLNQKV EQQRIIISEKEHSLVEQTNNNRLRAEV QLLHSSLEELKKLNNTMLDEHTALQLA FSSLEEKLRGVQDENRRLLERLMQYKS KDADKLNEENESIIRKRSAKLKRDLEDA | 348 |

TABLE 2-continued

Full-length sequences of autophagy proteins.

| NO | PRODUCT NAME | NCBI Accession | Sequence | SEQ ID NO |
|---|---|---|---|---|
| | | | VREPSSSSNAASSPGAASLQRNSSPAQF VGGLIGDEDFDEAAINGAMEAIGLDDN EYISARFTAGEIAENSRASIDTLKATGYL GQANPTKILMKFEAHENESHAVRWSPV ERMVATGGADRKVKLWDIGKNSTEPR AVLSGSSAGINSVDFDSTGAYILGTSND YGARVWTVMDNRLRHTLTGHSGKVM AAKYVQEPIKVVTGSHDRTLKIWDLRSI ACIETKFAGSSCNDLVTTDSLGSTIISGH YDKKIRFWDIRTEKQADDVLMPAKITS LDLSKDCNYLICSVRDDTIKLLDLRKNQ VISTFTNEHFKISCDFARASFNSSGLKIA CGSADGAIYIWNVGFLEATLKGHSTA VNAVSWSPNNNMLASVGKNKRCTIYS ES | |
| | autophagy 4a (APG4a) [Arabidopsis thaliana] | NP_850412.1 | MKALCDRFVPQQCSSSSKSDTHDKSPL VSDSGPSDNKSKFTLWSNVFTSSSSVSQ PYRESSTSGHKQVCTTRNGWTAFVKRV SMASGAIRRFQERVLGPNRTGLPSTTSD VWLLGVCYKISADENSGETDTGTVLAA LQLDFSSKILMTYRKGFEPFRDTTYTSD VNWGCMIRSSQMLFAQALLFHRLGRA WTKKSELPEQEYLETLEPFGDSEPSAFSI HNLIIAGASYGLAAGSWVGPYAICRAW ESLACKKRKQTDSKNQTLPMAVHIVSG SEDGERGGAPILCIEDATKSCLEFSKGQ SEWTPIILLVPLVLGLDSVNPRYIPSLVA TFTFPQSVGILGGKPGASTYIVGVQEDK GFYLDPHEVQQVVTVNKETPDVDTSSY HCNVLRYVPLESLDPSLALGFYCRDKD DFDDFCLRALKLAEESNGAPLFTVTQT HTAINQSNYGFADDDSEDEREDDWQML | 349 |
| | ATG10 (AUTOPHAGY 10); transporter [Arabidopsis thaliana] | NP_850533.1 | MDSAREVSDGRLTVEGFSVASRAFADK WKIHNQSFPPWSWVPLINRTLLVSKKQ EEGYLSLEKIIILSSLEEEIPEDESLNVAT DCLEKEETVDHTILVPTMENEAHYYDF HIVYSASYKVPVLYFRGYCSGGEPLAL DVIKKDVPSCSVSLLLESKWTFITQEEH PYLNRPWFKLHPCGTEDWIKLLSQSSSS SGCQMPIVLYLVSWFSVVGQVVGLRIP LEMLN | 350 |
| | microtubule- associated protein 1- light chain 3C [Danio rerio] | NP_956592.1 | MPPFEKTPHPKPFKQRKSLATRKQEVA GIRTKFPTKIPVIIERYQREKFLPPLDKT KFLVPQELTMTQFVTIIRNRMTLMPNQ AFYLLINNSGIASMSMTMAQLYKDHKD EDGFLYMTYASQEMFGHR | 351 |
| | AER298Cp [Ashbya gossypii ATCC 10895] | NP_985155.1 | MSQSLKFAPPFQSFVDASFFQVFSRLKL DVLRLDSHELPLHAKVDLAGLARGSSIS HVFLDSQSFDEATASLPGISLRGSFFNFN TLEEFKRLDKGRFLSEQAQLLWEAGVN GYLDEAAGFFVICFADLKKYRFYYWFA TPCFQPETLELKVVKREALTEIDKFSNFI EQNKILCGVLNEETGEVIRASRHELERY STLVVRDTSNIEHCPTSLVKNFVAVWR HHNPNRSECRVLLLRETCSFSLELSVTG DAMSTSQLKASGWERNVRGLLTPKISE LGAIIDPTKLAEQSIDLNLKLMKWRLVP DINLDIVKNCKVLLLGAGTLGCYVARS LLAWGVRKITFVDNGSVSYSNPVRQPL FNFTDCGQPKATSAAAAMKAIFPLVDA TGFQLEVPMIGHPLTDEARQKKDYEEL RQLIRDHDIVFLLMDSRETRWLPTILGN LESKLVINAALGFDSYLVMRHGNYEQP ESSRLGCYFCHDVVAPSDSLTDRTLDE MCTVTRPGVALIAAAYATELAVSVLQH PQGNNAPETSESVLGSVPHQLRGFLPQL STVKLRTPAYKHCSACSSVIVDAVREN GWEFLREALVDHRIVERLSGLAQVQQE TETFLATMEISDDDCFDEIS | 352 |

TABLE 2-continued

Full-length sequences of autophagy proteins.

| NO | PRODUCT NAME | NCBI Accession | Sequence | SEQ ID NO |
|---|---|---|---|---|
| | PREDICTED: similar to APG4 autophagy 4 homolog B [Homo sapiens] | XP_001126088.2 | MDAATLTYDTLRFAEFEDFPETSEPVWI LGRKYSIFTEKDEILSDVASRLWFTYRK NFPAIGGTGPTSDTGWGCMLRCGQMIF AQALVCRHLGRDWRWTQRKRQPDSYF SVLNAFIDRKDSYYSIHQIAQMGVGEG KSIGQWYGPNTVAQVLKKLAVFDTWS SLAVHIAMDNTVVMEEIRRLCRTSVPC AGATAFPADSDRHCNGFPAGAEVTNRP SPWRPLVLLIPLRLGLTDINEAYVETLK HCFMMPQSLGVIGGKPNSAHYFIGYVG EELIYLDPHTTQPAVEPTDGCFIPDESFH CQHPPCRMSIAELDPSIAVGFFCKTEDD FNDWCQQVKKLSLLGGALPMFELVEL QPSHLACPDVLNLSLGESCQVQVGSLG DSSDVERLERFFDSEDEDFEILSL | 353 |
| | PREDICTED: similar to microtubule-associated proteins 1A/1B light chain 3 [Pan troglodytes] | XP_001153028.1 | MEIFIVKRVWEQRVEDVRLIREQHPTKI PVIIERYKGEKQLPVLDKTKFLVPDHVN MSELIKIIRRRLQLNANQAFFLLVNGHS MVSVSTPISEVYESEKDEDGFLYMVYA SQETFGMKLSV | 354 |
| | PREDICTED: similar to APG4-D protein [Danio rerio] | XP_001333093.2 | MNSVSPSAVQYIVGGGAHEDKASASSK RHLGHGAVPDGIREGSGEPDEVDRLKA KFMSAWNNVKYGWTVKSKTSFNKSSP LILLGQSFLFNNEGEVERFRQTFVSCVW LTYRREFPQLDGSSLTTDCGWGCMLRS GQMMLAQGLLLHLMPTDWRWSDCHA LTDVDFEVLKPRSPSRPAGMSMPSFSSS WSSSIPQINPSPGITEAHRRAPARCPSAS PDPQVDALHRKVVSCFGDHPSAPFGVH QLVELGKESGKRAGDWYGPSVVAHML RKAVARAAEFEDLAVYVAQDCTVYKE DVMSLCESSGVGWKSVVILVPVRLGGE SLNPSYIECVKNILKLKCCIGIIGGKPKH SLFFVGFQDEQLLYLDPHYCQPVVDVT QANFSLESFHCNSPRKMNFSRMDPSCTI GLYARSKTDFESLCTAVSEALSSSKEKY PIFTFVEGRGQIYGMEGPSGGSVDAPAH IFTCSRLSRNNKRGSTDEFVLL | 355 |
| | PREDICTED: similar to autophagy protein 9 [Danio rerio] | XP_001345056.1 | MAHFDTEYQRLEASYSDSPPGEENLLV HVPEGSKSPWHHIENLDLFFQRISFNGF TCMLLGEIFELVQLVFVVAFTVFLANC VDYDILFANKFVNHTDSLKVTLPDAFL PVDVCSARIRDSVPVIFILVISGVFWLHR LVKFIYNICCYWEIRSFYINALKISMADL PYFTWQEVQARIVEIQKEHQICIHKKEL SELDIYHRILRFKNYMVAMVNKSLLPV RFRLPVLGDTVFYTRGLKYNFELIFFWG PGSLFENEWSLKSEYKRGGNRLELADR LSSRILWIGIANLLLCPVILIWQILYAFFS YTEVIKREPGSLGARCWSLYGRFYLRH FNELDHELMSRLSKGYKASSKYMNCF MSPLLTVVAKNVAFFAGSILAVLIALTI YDEDVLAVEHVLSSITLLGVCITVCRSFI PDKHMVFCPEQLLKVILAHIHYMPDHW QGNAHRYETRDEFAQLFQYKAVSHGV FILEELLSPVITPFILIFCLRRKSLEIIDFFR NFTVDVVGVGDTCSFAQMDVRQHGHP AWMSAGKTEASIYQQAEDGKTELSLM HFAITNPHWQPPRESTHFISLLKEKVHR DAAVGQQGIIAENAGFTSTHSLHNDSEP RSLIANLLMGPPSLASLHLGREGSINHV SIGVSEGASALRSLSPVSTSLHRGSYPS ARLPRSDHPAVVAGRGMAGSG | 356 |

TABLE 2-continued

Full-length sequences of autophagy proteins.

| NO | PRODUCT NAME | NCBI Accession | Sequence | SEQ ID NO |
|---|---|---|---|---|
| | AGAP007296-PA [Anopheles gambiae str. PEST] | XP_308525.2 | MAEEAEATGIDNNSEKDLATNVENLSL TNQKVEKQESKKIDIVLHATGSAPILKQ KKWAVDQEKPISAIVKFIHKYLKLDAE ERLFLYINQTFAPSPDQIIKNLYECYGTN GKLILHYAKTQAWG | 357 |
| | AGAP010939-PA [Anopheles gambiae str. PEST] | XP_309756.4 | MANDREILREIWEGKIPVHFKLSADETD VEPEEYFLLIPRLSYFPLVTDKVRKHFL RFVSNELQDGEMWMDSNGTPLKWHFP IGVLYDLLVGTDGTLPWHVTVHFSKFP DDILIRCPNKEIVEAHFMSSLKEADVLK HRGQVVSAMQKKDHNQLWLGLVNDK FDQFWAVNRRLMEPIPDQDGFKHIPVR CYAEDGTYQQKLVAPSTASGQKRLLQ DLLDDFSTPVRKAVEARTHGVTVPEST PLQWLSEHLSYPDNFLHLCLSYA | 358 |
| | AGAP003858-PA [Anopheles gambiae str. PEST] | XP_310418.5 | MNDAKVSVSFSCQRCMQPIHVDDTFAS LGEHTLAELALPINSHLEVDLESQSVSF DHFVPPFRVTDSTNDTNGFMLLSDGQN KESLGHSLRVKAELFDALSNNSEIDHPL CDECTDTLLELMDKQLKIAEDEWNDY NNYLKKLEMTDDVPNIDELEQELAGLK EDETRLLEELSSLSREEQSIRQAVEEQEK EKQRLEREENKYWREYTKHRRDVITTE DEFRSLECQMAYAQSQLEKLKKTNVFN ATFHIWHSGHFGTINNFRLGRLPSAPVD WSEINAAWGQTCLLLSALARKMNFSFK QYRLVPYGNHSYIEVLGEGKELPLYGN GGFRFLWDSKYDAAMVAFLDCLQQFK EEIVRRDPDFCLPYLMEKGKIEDASTGS SFSIKIQFNSEEQWTKALKYLLTNLKWV LTWVSSQFTEDKQR | 359 |
| | AGAP002319-PA [Anopheles gambiae str. PEST] | XP_312653.3 | KLLLICRLFSSFLPQHTLTGHSGKVLAA KFLGSAFLVTGSHDRTLKIWDLKNRSC TETKFAGSSCNDLVTTDSFSFISGHVDK KIRFWDVRTADCTANDIPLQGKITSLDL SKDGKFLLSCVRDDTINLLDLRQNRIVR TFRNDNFKVGCDWSRVAFSPSSSRIAA GSADGSVYIWNINGPLETVLKDPNGSG AAVTAVSWHPFSSTLASVDRAKKCTIW SNA | 360 |
| | AGAP008497-PA [Anopheles gambiae str. PEST] | XP_316946.4 | GKMLDAYVGYDLSIATEPDDIPKTNDT VWILGKQYNASDDLEAIRQDVQSRLW CTYRRGFVPIGNTQLTTDKGWGCMLR CGQMVLAQALLQLHLGRDWVWEAET RDDIYLNIVNRFEDSKQAPFSLHQIALM GDSSEEKRIGEWFGPNTVAQVLKKLVK FDDWCRLVIHVALDNTVATDEIVELCV DKKEPEAWKPLLLIIPLRLGLSEVNPIYI EGLKKCFQLPGSCGMIGGRPNQALYFI GYVGGEALYLDPHTVQRVGTVGSKQD PAEQELDETFHQRYASRISFTSMDPSLA VCFLCVSRQQFDQLVARFNDSVNGGTS QALFEVTKTRQAPWTPTTASSASSRKN SGPTEAFNVISATEIPNEEFEEVEPRTLD DSDEEFEIIA | 361 |
| | ENSANGP 00000001364 [Anopheles gambiae str. PEST] | XP_318212.3 | AWGITHISIVDCGHISLSNPIRQSLYRYE DTLNGGKPKASTVAERLLEINPSAKITGI NLKIPMPGHPVGQGNEVNETREILTKLI NLIQQHDVIYLLTDSRESRWLPTMLGRF YNKIVMNAALGFDSYLVMRHGFQTNN IMEADGDTNLSSTVIAGFHKINCCDLGC YFCNDIVAPGNSMKDRTLDQQCTVTRP GVSNMASALAVELMISIQHGDAPAYY RTPKSDPHAQQQEPEGLLGIIPHSIRGNI STLQSMVTATARYTNCVACSSLVLERY ATSGQDFIINVLNGSESLEAIVGL | 362 |

TABLE 2-continued

Full-length sequences of autophagy proteins.

| NO | PRODUCT NAME | NCBI Accession | Sequence | SEQ ID NO |
|---|---|---|---|---|
| | hypothetical protein [Neurospora crassa OR74A] | XP_326958.1 | MDLKFATFSSEIELPFYSALFSSKLDHD KLDSSARPVLGLYEPRSHASPEASTRM QILGSALTSDQDESGPLGMTRAEGYIKN VNTIEEFKNTDKNAMIKKAGEQIWDAI QDGTIYSCPSLLASFRILSYADLKKYKF TYWFAFPALHSEPQWKRTGPIGRLTSD ESTALVERIGTWRYMVDRREHGFFLAK KVRREAAGPRSSLDDPGVDIGYRWDIG SLRDFETGFFNDAAEEDRYVAFVDPSN YPEYPSWPLRNLLILIRQRYRLNKVQIL CYRDTQPRRHEARSTILPLAMDQVGDV ELKCMPKVTGWERNGNGDLRPRVANL AEYMDPTRLADQAVDLNLKLMKWRL APNLDLDAIKNTKCLLLGAGTLGSYVS RNLLGWGVRKITFIDYGSVSYSNPVRQ PLFKFEDCHNGGKPKAIQAAEALKEIYP GVDVEGYALSVPMLDHAIHNEAKTKA DFDKLKELIDSHDAIFLLMDTRESRWLP TLMGKAANKIVMNAALGFDTYVVMR HGAAPNDGSEETLGCYFCNDVVVAAD SMKDQTLDQQCTVTRPGVAAIASALLV ELLTSILQHPLKQHAPAPVSTGTGSAVS YERDPPDHPLGLVPHQVRGFLSNFQNM VIRGKSYPQCSACSKPILDAYKEGGWE FVKTALASRDYVAELSGLAEVQRLAEK AAAEMQWSEDEEGMDEEEGEGELI | 363 |
| | hypothetical protein [Neurospora crassa OR74A] | XP_330558.1 | MFKRHAGPGRGGGGDGALRDNPAMSF VLLTESQIASSDALSLQKNNRSSAQDLS SGAYSSNNSNTNNNNVGASEEDDMAN AHLSDQMERILKLFEVISARSDIDHPICI ECSDMLVEEMQKKLESANREKDAYVN YLKELKASEPTDEEIRAQEEATRKAKQ AEKELLEELKALEQEQAALEREKLELE AEIREVDIKEEEFWRARNGFNTTLIDFQ NERDSINSKFDHDSRQLEKLQRSNVFN DTFCISHDGTFATINGLRLGRMHNVPV DWPEINAAWGHALLLLVTVAEKLNFRF EGYEPQPMGSTSRIVRIEPASTSMASSF YPSRPVDANAPPPPAKRTVLELYSSGDF PLGFTFIHRKFDTAMVAFLELVRQLGV HVQEQTRREGNPLSLPYQIQGDKISDVS IKLGVQQDDSWAKACKLTLTCCKFLLA HASNSWLHDYDFEAYEILDCILIGENSLG | 364 |
| | hypothetical protein [Neurospora crassa OR74A] | XP_331198.1 | MADGVIARLMSGGRGARSFYEELRGR DNVSDVDDRAGLLDEENLNQHFNDYD LENAEGLRLEDSRATVDGRIPRGRAQL SGRPPRPAATTHWGTSHDDDGDNDVP ASLLVERYDRGAAPLGSPGKPRSQHAG SRAHPAPGLSKGRTHQQRPHIDQELQPP LHSDAAPSSLLAGAITGNAKKMAEWR WANITNLDSFMQDVYSYYRGSGMWCI VVERVLHLIKVAFVAFLLTFLSQCVDFK KIPSNQKLSQVLVPQCTRNMSGLWNIG LWLFAFYFMWKSIQYILDLRRLTHVRD FYIHLLNIPDEDMQTITWQEVVARIMVL RDQNVRTTRTITPQNQRWVLGSQSKER LDASDIANRLMRRENYMIAMINKDILD LTIPLPILRNRQLLSQTLEWTLMFSILDF VFDPKGQVHQEFLRSDRRGILSAKLRSR FIFAGVMILILSPFVAGYLIIVYFLEYYN EIQKNPSILSARSYTPLAEWKFREFNELP HLFKRRLDMSHPFASHYIDQFPKAKTS MVAKTVSFIAGSIATVLALISVFDPEMF LGFEITHDRTVLFYTAVFGAIWSVARGS VSEDNAVFDPEYALGNVVEYTHYQPEH WKDRWHSADVKAEFEELYKLKLVIFIE EILSILTTPFVLFFSLPKSADQIIDFFREFT IHVDGLGYVCYFAEFDFKKGSKSQAPA ATAGEGDVRDDYYSTKHGKMEASMY GFINNYARNPKHLPPAMRQQFHLPPVF PGITSPTLAGDLAASRMGRSQRGRSKG PLPSRTPRPGAVMAEPSPMASILLDPRH | 365 |

TABLE 2-continued

Full-length sequences of autophagy proteins.

| NO | PRODUCT NAME | NCBI Accession | Sequence | SEQ ID NO |
|---|---|---|---|---|
| | | | QPIFPNNMSFVNTGHQFRGGNQGDGH MMGGGSMEEDVKGAARHGQQTHDDE SEDSRAGLDESAWQVSPTKDLSRENSG RGLDSVVGEEAGNGAGVVHMLYQFNQ AHLNRRLGGVR | |
| | hypothetical protein MGG_03694 [Magnaporthe grisea 70-15] | XP_361151.2 | MFCQKCRTPLKLDGSLDDLNPAAYDLL VTTSSQQQAHKDATSLSSPNPAHVHDQ NRKAAYESAIKNAIGSPTFKRRSDITGL RGDKAMRDSSMSFILLEESQIAPSRHGA AGRSSGPASPNASKGSAATPAADDDSA NETNRMLRLFEILSARSDIDHPVCVECT DILVEGLRKRLESASRERTTYVNFLKKL ELESPTDDELKAQEEALAKAKEQEAAA LKELVALEKEKASLDDEILALEEESRRM DAEEEQFWRERNAFASQLADFQNERDS INSKYDHDARLLQSLQRTNVYNDTFLIS HDGTFATINGLRLGRLHNTPVDWPEIN AAWGHALLLVATVADKLQYRFDGYEP QPMGSMSRIIRFEPPSPAASRVGSAPPQ APKKKVLELYSSGDMPLGLTFMHRKL DAAMVAYLELVRQLGMFMVRTTTAN GKPLTLPYVIDGDKINGVSIKLGIAQDD AWTKACKFVLTCCKFLLAHASNISTMA NGRGKVLGSSST | 366 |
| | hypothetical protein MGG_09559 [Magnaporthe grisea 70-15] | XP_364714.1 | MASNIFSRLVPQDRGRSFYEDLRQTDP DADLESRAGIDIDEENLNRSYHDYDLD EAERLAGDESHISHSRGDVAGANTVHR RGQKANTARWLGAGVEDDVDNDVPES LLVETPRAPQHLLLSPSRAGPSHPRPTA VPGPSTRQNQAQWEATRHQQRLHNDD TMPHGPFSGRAGQGRPEPPPVGLMAGD PYEQAMWRWVNVSNLDNFIKDVYAY YRAAGFWCIIVQRILELVNAAFVAVFLT FLSQCVDYHKLPHSKKMEDIIIPKCTQN MSLVWNVGLWLFAIYFICRCFGLIIQLR QLKHLRDFYTHLLKIPEADMQSVSWQD VVGRIMALRDSHPRTAGNLTRVQRAWI GSQSKERLDAHDIANRIMRRENFMIAM LNKDVLDLTIPLPFFRNKQHMSECVVL AISFSILDFVFDNQGQVNPEFLKASRRR QLSQKLKSRFFFAGLMIFVMSPFIALYLI LVYFLTYFHEFRNDPGALGARTYNSLA KWKFREFNELDHLFNDRMNMSHPFAK RYIDMFPKRKTEQVARTVSFITGSIVAV LGLATIFDSEAFLTFEITPDRSVLFYVSIL ATLWAVARGNISDDNEVYDPEFAMKSI IEFTHYEPDHWRGRLHSTEVKNEFSELY KPRPQIFLEEILSILLTPLVLLVSLPNSTD QIVDFFREFTIHVDGLGYVCLFSVFNFQ QGHANQKQAAAADAPDNREEYYSTKH GKMAASFYGFLDHYVINPKTGLPGNQL PGSRQQFQHPPSFPGLQSPTLAADMRHS RMMRERGRSSGVQIQGSQGRTPQFRTP MPQPSPMASILLDPHHQPAPGAFGSRS MHRSRQMAVPHRGGYMSDRDIIEEAV TEDGQDDARFGKLGDEDIDESGGALDE STWQTSPTKTLSRENSGANPQETEVGV LGLIHQFQQAHMHLRR | 367 |
| | hypothetical protein MGG_07297 [Magnaporthe grisea 70-15] | XP_367372.2 | MSGNDEAAAGVAPPQTLQFAPFESQI EMPFYSALFSRKLDHDKLDDSVRPVIG LYQPMSERPPAESTRMQIQGGALSSSH VPMGYTRADGSIRNFNTIEDFKKADKG AILRQAGAQIWDAIKDGSIYEIPSLLSSF AILSYADLKKYRFTYWFAYPTLHSVPA WRRDGPLARFSSKETTALVNEVGTFRY AHDTRQHGFFLAKKVPYRSGPFRRGLP RDDSDGDDIGFTWSIGALGEFEKGFFK GIKEEDQYIAFVDSSSYAENPSWPLRNL LVLIRQRFQLQKANILCYRDTQARRDEP RSIVLPLASEGPATPQTSEMPKVTGWER HPSSKLQARVISLAEYMDPTRIADQAV DLNLKLMKWRISPKLDLEAMRSLKCLL | 368 |

TABLE 2-continued

Full-length sequences of autophagy proteins.

| NO | PRODUCT NAME | NCBI Accession | Sequence | SEQ ID NO |
|---|---|---|---|---|
| | | | LGAGTLGSYVSRNLMGWGVRKITFVD YGNVSFSNPVRQPLFEFEDCLSGGVPK APKAAEALKKINPGVEAEGHVLSVPML GHPVLNEAQTKEDFEKLQQLIKAHDVV FLLMDTRESRWLPTVMGKAEGKIVMN AALGFDTYVVMRHGAAPKDGTESTLG CYFCNDVVAPSDSMKDQTLDQQCTVT RPGVAAIASAMLVEMLTSVLQHPQREH APAPKATGPPGNPEYQRDPPDHALGIVP HQVRGFLANFQNMIISGESYPNCSACSS PIVGAYKSDGWEFVKKALSDKDYVLEL SGLAEVQRQAEAMQNEVDWDEDEDV AAAEEGDGEML | |
| | PREDICTED: hypothetical protein [Gallus gallus] | XP_417327.2 | MPSDRAFKQRRTFADRCKEVQQIREQH PNKIPVIIERYKGEKQLPVLDKTKFLVP DHVNMSELVKIIRRRLQLNPTQAFFLLV NQHSMVSVSTPISEIYEQEKDEDGFLYM VYASQETFGY | 369 |
| | PREDICTED: similar to MAP1 light chain 3-like protein 2 [Gallus gallus] | XP_419549.2 | MQAGPGVQAVRPFKLRKSLATRREEV AGIRAKFPTKIPVIVERYQKEKYLPLLD KTKFLVPEELTMTQFITIIRSRMALTATQ AFYLLVNNKSLASMSLTMAEVYRDYK DEDGFVYMTYASQEMFGCCSLTLGKT MECHHKT | 370 |
| | PREDICTED: hypothetical protein [Gallus gallus] | XP_424902.2 | MSCSMAVEEDFFLEEKRFKQYCEEFVK HSQQIGDGWEWRTTKDLGDGYLSKTH FQVTNKSISPDLKKENGSTEQTLLTHVE ESSDDSQVAGVCATEEVIRYEYHVLYS SSYQVPVLYFRACFLDGRPLTLDEIWKS VHVCYQARLQEGPWDTITQQEHPLLGQ PFFVLHPCRTNEFMCSILAGSQKDNRHR NYIVLWLSTVGPVVGLTLPLSYAKLEPE ENTNAEID | 371 |
| | unnamed protein product [Kluyveromyces lactis] | XP_455132.1 | MTDLTLRCMHCHSMLEIDVSLMDLSM AQRDLLVSSDANTSGKDSSANSNQIPA DKLKVMKEVKQPSQLRLTKPGNIASDS YVFPLTDTEYSLQKSKIGGDESGDEEDY DDRNKTLSSRINALGNIFNILSSKNNVD YPVCQGCCDTLLEKLKEEYNQELKKRD TYHDFMKRIQEHKNVNGINIGDNRALE ELSSLKKEKEQLLRELQRLEDEDEKLQ KETILLQEELAKKKDQYIVRLQKQNIQE LEQLTFIKDVQSLKNQRVVTLNHIDKLR KLNIYNETFRISHDGPFGTINDLKLGSVP NASVPWSEINSALGQVVLLLSLIAEKLS VSFTDYKLIPMGSTSSIEKFDPKTNQWF VHKAFSGDEFSFGSLFHKESAIDKALTC ILEIISLLSAKVSSDSQDPASIELPYEILG DKINGLTILLNGATPSLEWTTSCKFLLT NVKWLLAFSTAHIDKNKP | 372 |
| | PREDICTED: similar to microtubule-associated protein 1 light chain 3 alpha isoform 1 [Canis familiaris] | XP_534391.2 | MPSDRPFKQRRTFADRCKEVQQIRDQH PSKIPVIIERYKGEKQLPVLDKTKFLVPD HVNMSELVKIIRRRLQLNPTQAFFLLVN QHSMVSVSTPIADIYEQEKDDDGFLYM VYASQETFGF | 373 |
| | PREDICTED: similar to MAP1 light chain 3-like | XP_584030.2 | MQTPQKSPSLRPFKQRKSLATRREEVA GIRVKFPGKIPVIVERYPREKFLPRLDKT KFLVPQELTMTQFLSVIRSRMVLGATE AFYLLVNNKSLGSMNVTMAEIYRDYK DEDGFVYMTYASQEMFGCLGSAAPED | 374 |

TABLE 2-continued

Full-length sequences of autophagy proteins.

| NO | PRODUCT NAME | NCBI Accession | Sequence | SEQ ID NO |
|---|---|---|---|---|
| | protein 2 isoform 1 [Bos taurus] | | ASSLGEDRPCHPL | |
| | PREDICTED: ATG12 autophagy related 12 homolog (S. cerevisiae) [Danio rerio] | XP_699602.3 | MSDNAESPTENPKDEHSLQHAVTDHSE SSDEKKKIDVLLKAVGDTPIMKTKKWS VERRRTIQSLAQFISRFLKLEPSEQLFIY VNQSFAPSPDQEVGVLFECFGSDGKLV LHYCKSQAWG | 375 |

TABLE 3

Epitopes that include the phosphorylation site in autophagy proteins.

| NO | PRODUCT NAME | Sequence (SEQ ID NO) |
|---|---|---|
| 1 | APG3L-pY18 X = Tyrosine or Phosphotyrosine | EVAEX (376), VAEXL (377), AEXLT (378), EXLTP (379), XLTPV (380), LEVAEX (381), EVAEXL (382), VAEXLT (383), AEXLTP (384), EXLTPV (385), XLTPVL (386), LEVAEXL (387), EVAEXLT (388), VAEXLTP (389), AEXLTPV (390), EXLTPVL (391), LEVAEXLT (392), EVAEXLTP (393), VAEXLTPV (394), AEXLTPVL (395), LEVAEXLTP (396), EVAEXLTPV (397), VAEXLTPVL (398), LEVAEXLTPV (399), EVAEXLTPVL (400), LEVAEXLTPVL (401) |
| 2 | APG3L-pY160 X = Tyrosine or Phosphotyrosine | DMEEX (402), MEEXE (403), EEXEE (404), EXEES (405), XEESG (406), ADMEEX (407), DMEEXE (408), MEEXEE (409), EEXEES (410), EXEESG (411), XEESGL (412), ADMEEXE (413), DMEEXEE (414), MEEXEES (415), EEXEESG (416), EXEESGL (417), ADMEEXEE (418), DMEEXEES (419), MEEXEESG (420), EEXEESGL (421), ADMEEXEES (422), DMEEXEESG (423), MEEXEESGL (424), ADMEEXEESG (425), DMEEXEESGL (426), ADMEEXEESGL (427) |
| 3 | APG4A-pS6 X = Serine or Phosphoserine | ESVLX (428), SVLXK (429), VLXKY (430), LXKYE (431), XKYED (432), MESVLX (433), ESVLXK (434), SVLXKY (435), VLXKYE (436), LXKYED (437), XKYEDQ (438), MESVLXK (439), ESVLXKY (440), SVLXKYE (441), VLXKYED (442), LXKYEDQ (443), MESVLXKY (444), ESVLXKYE (445), SVLXKYED (446), VLXKYEDQ (447), MESVLXKYE (448), ESVLXKYED (449), SVLXKYEDQ (450), MESVLXKYED (451), ESVLXKYEDQ (452), MESVLXKYEDQ (453) |
| 4 | APG4A-pS62 X = Serine or Phosphoserine | RRKFX (454), RKFXP (455), KFXPI (456), FXPIG (457), XPIGG (458), YRRKFX (459), RRKFXP (460), RKFXPI (461), KFXPIG (462), FXPIGG (463), XPIGGT (464), YRRKFXP (465), RRKFXPI (466), RKFXPIG (467), KFXPIGG (468), FXPIGGT (469), YRRKFXPI (470), RRKFXPIG (471), RKFXPIGG (472), KFXPIGGT (473), YRRKFXPIG (474), RRKFXPIGG (475), RKFXPIGGT (476), YRRKFXPIGG (477), RRKFXPIGGT (478), YRRKFXPIGGT (479) |
| 5 | APG4A-pS100 X = Serine or Phosphoserine | GRDWX (480), RDWXW (481), DWXWE (482), WXWEK (483), XWEKQ (484), LGRDWX (485), GRDWXW (486), RDWXWE (487), DWXWEK (488), WXWEKQ (489), XWEKQK (490), LGRDWXW (491), GRDWXWE (492), RDWXWEK (493), DWXWEKQ (494), WXWEKQK (495), LGRDWXWE (496), GRDWXWEK (497), RDWXWEKQ (498), DWXWEKQK (499), LGRDWXWEK (500), GRDWXWEKQ (501), RDWXWEKQK (502), LGRDWXWEKQ (503), GRDWXWEKQK (504), LGRDWXWEKQK (505) |
| 6 | APG4B-pS121 X = Serine or Phosphoserine | DRKDX (506), RKDXY (507), KDXYY (508), DXYYS (509), XYYSI (510), IDRKDX (511), DRKDXY (512), RKDXYY (513), KDXYYS (514), DXYYSI (515), XYYSIH (516), IDRKDXY (517), DRKDXYY (518), RKDXYYS (519), KDXYYSI (520), DXYYSIH (521), IDRKDXYY (522), DRKDXYYS (523), RKDXYYSI (524), KDXYYSIH (525), IDRKDXYYS (526), DRKDXYYSI (527), RKDXYYSIH (528), IDRKDXYYSI (529), DRKDXYYSIH (530), IDRKDXYYSIH (531) |

TABLE 3-continued

Epitopes that include the phosphorylation site in autophagy proteins.

| PRODUCT NO | NAME | Sequence (SEQ ID NO) |
|---|---|---|
| 7 | APG4B-pS309<br>X = Serine or<br>Phosphoserine | PCRMX (532), CRMXI (533), RMXIA (534), MXIAE (535), XIAEL (536), PPCRMX (537), PCRMXI (538), CRMXIA (539), RMXIAE (540), MXIAEL (541), XIAELD (542), PPCRMXI (543), PCRMXIA (544), CRMXIAE (545), RMXIAEL (546), MXIAELD (547), PPCRMXIA (548), PCRMXIAE (549), CRMXIAEL (550), RMXIAELD (551), PPCRMXIAE (552), PCRMXIAEL (553), CRMXIAELD (554), PPCRMXIAEL (555), PCRMXIAELD (556), PPCRMXIAELD (557) |
| 8 | APG4C-pS166<br>X = Serine or<br>Phosphoserine | EASLX (558), ASLXG (559), SLXGE (560), LXGER (561), XGERE (562), FEASLX (563), EASLXG (564), ASLXGE (565), SLXGER (566), LXGERE (567), XGEREF (568), FEASLXG (569), EASLXGE (570), ASLXGER (571), SLXGERE (572), LXGEREF (573), FEASLXGE (574), EASLXGER (575), ASLXGERE (576), SLXGEREF (577), FEASLXGER (578), EASLXGERE (579), ASLXGEREF (580), FEASLXGERE (581), EASLXGEREF (582), FEASLXGEREF (583) |
| 9 | APG4C-pS177<br>X = Serine or<br>Phosphoserine | TPTIX (584), PTIXL (585), TIXLK (586), IXLKE (587), XLKET (588), KTPTIX (589), TPTIXL (590), PTIXLK (591), TIXLKE (592), IXLKET (593), XLKETI (594), KTPTIXL (595), TPTIXLK (596), PTIXLKE (597), TIXLKET (598), IXLKETI (599), KTPTIXLK (600), TPTIXLKE (601), PTIXLKET (602), TIXLKETI (603), KTPTIXLKE (604), TPTIXLKET (605), PTIXLKETI (606), KTPTIXLKET (607), TPTIXLKETI (608), KTPTIXLKETI (609) |
| 10 | APG4C-pS224<br>X = Serine or<br>Phosphoserine | YGKKX (610), GKKXG (611), KKXGK (612), KXGKK (613), XGKKA (614), EYGKKX (615), YGKKXG (616), GKKXGK (617), KKXGKK (618), KXGKKA (619), XGKKAG (620), EYGKKXG (621), YGKKXGK (622), GKKXGKK (623), KKXGKKA (624), KXGKKAG (625), EYGKKXGK (626), YGKKXGKK (627), GKKXGKKA (628), KKXGKKAG (629), EYGKKXGKK (630), YGKKXGKKA (631), GKKXGKKAG (632), EYGKKXGKKA (633), YGKKXGKKAG (634), EYGKKXGKKAG (635) |
| 11 | APG4C-pS398<br>X = Serine or<br>Phosphoserine | FKRAX (636), KRAXE (637), RAXEE (638), AXEEI (639), XEEIT (640), DFKRAX (641), FKRAXE (642), KRAXEE (643), RAXEEI (644), AXEEIT (645), XEEITK (646), DFKRAXE (647), FKRAXEE (648), KRAXEEI (649), RAXEEIT (650), AXEEITK (651), DFKRAXEE (652), FKRAXEEI (653), KRAXEEIT (654), RAXEEITK (655), DFKRAXEEI (656), FKRAXEEIT (657), KRAXEEITK (658), DFKRAXEEIT (659), FKRAXEEITK (660), DFKRAXEEITK (661) |
| 12 | APG4C-S408<br>X = Serine or<br>Phosphoserine | MLKFX (662), LKFXS (663), KFXSK (664), FXSKE (665), XSKEK (666), KMLKFX (667), MLKFXS (668), LKFXSK (669), KFXSKE (670), FXSKEK (671), XSKEKY (672), KMLKFXS (673), MLKFXSK (674), LKFXSKE (675), KFXSKEK (676), FXSKEKY (677), KMLKFXSK (678), MLKFXSKE (679), LKFXSKEK (680), KFXSKEKY (681), KMLKFXSKE (682), MLKFXSKEK (683), LKFXSKEKY (684), KMLKFXSKEK (685), MLKFXSKEKY (686), KMLKFXSKEKY (687) |
| 13 | APG4C-pS451<br>X = Serine or<br>Phosphoserine | LKRFX (688), KRFXT (689), RFXTE (690), FXTEE (691), XTEEF (692), QLKRFX (693), LKRFXT (694), KRFXTE (695), RFXTEE (696), FXTEEF (697), XTEEFV (698), QLKRFXT (699), LKRFXTE (700), KRFXTEE (701), RFXTEEF (702), FXTEEFV (703), QLKRFXTE (704), LKRFXTEE (705), KRFXTEEF (706), RFXTEEFV (707), QLKRFXTEE (708), LKRFXTEEF (709), KRFXTEEFV (710), QLKRFXTEEF (711), LKRFXTEEFV (712), QLKRFXTEEFV (713) |
| 14 | APG4D-S15<br>X = Serine or<br>Phosphoserine | YRSSX (714), RSSXP (715), SSXPE (716), SXPED (717), XPEDA (718), QYRSSX (719), YRSSXP (720), RSSXPE (721), SSXPED (722), SXPEDA (723), XPEDAR (724), QYRSSXP (725), YRSSXPE (726), RSSXPED (727), SSXPEDA (728), SXPEDAR (729), QYRSSXPE (730), YRSSXPED (731), RSSXPEDA (732), SSXPEDAR (733), QYRSSXPED (734), YRSSXPEDA (735), RSSXPEDAR (736), QYRSSXPEDA (737), YRSSXPEDAR (738), QYRSSXPEDAR (739) |
| 15 | APG4D-pS341<br>X = Serine or<br>Phosphoserine | KPRHX (740), PRHXL (741), RHXLY (742), HXLYF (743), XLYFI (744), GKPRHX (745), KPRHXL (746), PRHXLY (747), RHXLYF (748), HXLYFI (749), XLYFIG (750), GKPRHXL (751), KPRHXLY (752), PRHXLYF (753), RHXLYFI (754), HXLYFIG (755), GKPRHXLY (756), KPRHXLYF (757), PRHXLYFI (758), RHXLYFIG (759), GKPRHXLYF (760), KPRHXLYFI (761), PRHXLYFIG (762), GKPRHXLYFI (763), KPRHXLYFIG (764), GKPRHXLYFIG (765) |

TABLE 3-continued

Epitopes that include the phosphorylation site in autophagy proteins.

| NO | PRODUCT NAME | Sequence (SEQ ID NO) |
|---|---|---|
| 16 | APG4D-pS467<br>X = Serine or<br>Phosphoserine | AKRPX (766), KRPXS (767), RPXSE (768), PXSED (769), XSEDF (770), RAKRPX (771), AKRPXS (772), KRPXSE (773), RPXSED (774), PXSEDF (775), XSEDFV (776), RAKRPXS (777), AKRPXSE (778), KRPXSED (779), RPXSEDF (780), PXSEDFV (781), RAKRPXSE (782), AKRPXSED (783), KRPXSEDF (784), RPXSEDFV (785), RAKRPXSED (786), AKRPXSEDF (787), KRPXSEDFV (788), RAKRPXSEDF (789), AKRPXSEDFV (790), RAKRPXSEDFV (791) |
| 17 | APG5L-pY35<br>X = Tyrosine or<br>Phosphotyrosine | EAEPX (792), AEPXY (793), EPXYL (794), PXYLL (795), XYLLL (796), REAEPX (797), EAEPXY (798), AEPXYL (799), EPXYLL (800), PXYLLL (801), XYLLLP (802), REAEPXY (803), EAEPXYL (804), AEPXYLL (805), EPXYLLL (806), PXYLLLP (807), REAEPXYL (808), EAEPXYLL (809), AEPXYLLL (810), EPXYLLLP (811), REAEPXYLL (812), EAEPXYLLL (813), AEPXYLLLP (814), REAEPXYLLL (815), EAEPXYLLLP (816), REAEPXYLLLP (817) |
| 18 | APG5L-pS225<br>X = Serine or<br>Phosphoserine | EVCPX (818), VCPXA (819), CPXAI (820), PXAID (821), XAIDP (822), KEVCPX (823), EVCPXA (824), VCPXAI (825), CPXAID (826), PXAIDP (827), XAIDPE (828), KEVCPXA (829), EVCPXAI (830), VCPXAID (831), CPXAIDP (832), PXAIDPE (833), KEVCPXAI (834), EVCPXAID (835), VCPXAIDP (836), CPXAIDPE (837), KEVCPXAID (838), EVCPXAIDP (839), VCPXAIDPE (840), KEVCPXAIDP (841), EVCPXAIDPE (842), KEVCPXAIDPE (843) |
| 19 | APG7L-pS95<br>X = Serine or<br>Phosphoserine | NTLEX (844), TLEXF (845), LEXFK (846), EXFKT (847), XFKTA (848), TNTLEX (849), NTLEXF (850), TLEXFK (851), LEXFKT (852), EXFKTA (853), XFKTAD (854), TNTLEXF (855), NTLEXFK (856), TLEXFKT (857), LEXFKTA (858), EXFKTAD (859), TNTLEXFK (860), NTLEXFKT (861), TLEXFKTA (862), LEXFKTAD (863), TNTLEXFKT (864), NTLEXFKTA (865), TLEXFKTAD (866), TNTLEXFKTA (867), NTLEXFKTAD (868), TNTLEXFKTAD (869) |
| 20 | APG7L-pS173<br>X = Serine or<br>Phosphoserine | DQRFX (870), QRFXL (871), RFXLK (872), FXLKQ (873), XLKQI (874), LDQRFX (875), DQRFXL (876), QRFXLK (877), RFXLKQ (878), FXLKQI (879), XLKQIE (880), LDQRFXL (881), DQRFXLK (882), QRFXLKQ (883), RFXLKQI (884), FXLKQIE (885), LDQRFXLK (886), DQRFXLKQ (887), QRFXLKQI (888), RFXLKQIE (889), LDQRFXLKQ (890), DQRFXLKQI (891), QRFXLKQIE (892), LDQRFXLKQI (893), DQRFXLKQIE (894), LDQRFXLKQIE (895) |
| 22 | APG8b-pT12<br>X = Threonine or<br>Phosphothreonine | KQRRX (896), QRRXF (897), RRXFE (898), RXFEQ (899), XFEQR (900), FKQRRX (901), KQRRXF (902), QRRXFE (903), RRXFEQ (904), RXFEQR (905), XFEQRV (906), TFKQRRX (907), FKQRRXF (908), KQRRXFE (909), QRRXFEQ (910), RRXFEQR (911), RXFEQRV (912), TFKQRRXF (913), FKQRRXFE (914), KQRRXFEQ (915), QRRXFEQR (916), RRXFEQRV (917), TFKQRRXFE (918), FKQRRXFEQ (919), KQRRXFEQR (920), QRRXFEQRV (921), TFKQRRXFEQ (922), FKQRRXFEQR (923), KQRRXFEQRV (924), TFKQRRXFEQR (925), FKQRRXFEQRV (926), TFKQRRXFEQRV (927) |
| 23 | APG8b-pS101<br>X = Serine or<br>Phosphoserine | EVYEX (928), VYEXE (929), YEXEK (930), EXEKD (931), XEKDE (932), SEVYEX (933), EVYEXE (934), VYEXEK (935), YEXEKD (936), EXEKDE (937), XEKDED (938), SEVYEXE (939), EVYEXEK (940), VYEXEKD (941), YEXEKDE (942), EXEKDED (943), SEVYEXEK (944), EVYEXEKD (945), VYEXEKDE (946), YEXEKDED (947), SEVYEXEKD (948), EVYEXEKDE (949), VYEXEKDED (950), SEVYEXEKDE (951), EVYEXEKDED (952), SEVYEXEKDED (953) |
| 25 | APG8c-pS137<br>X = Serine or<br>Phosphoserine | PRDGX (954), RDGXS (955), DGXSL (956), GXSLE (957), XSLED (958), PRDGXS (959), RDGXSL (960), DGXSLE (961), GXSLED (962), XSLEDR (963), PRDGXSL (964), RDGXSLE (965), DGXSLED (966), GXSLEDR (967), XSLEDRP (968), PRDGXSLE (969), RDGXSLED (970), DGXSLEDR (971), GXSLEDRP (972), PRDGXSLED (973), RDGXSLEDR (974), DGXSLEDRP (975), PRDGXSLEDR (976), RDGXSLEDRP (977), PRDGXSLEDRP (978) |

TABLE 3-continued

Epitopes that include the phosphorylation site in autophagy proteins.

| NO | PRODUCT NAME | Sequence (SEQ ID NO) |
|---|---|---|
| 26 | APG8c-pS137/138<br>X = Serine or Phosphoserine | PRDGXX (979), RDGXXL (980), DGXXLE (981), GXXLED (982), XXLEDR (983), PRDGXXL (984), RDGXXLE (985), DGXXLED (986), GXXLEDR (987), XXLEDRP (988), PRDGXXLE (989), RDGXXLED (990), DGXXLEDR (991), GXXLEDRP (992), XXLEDRP (993), PRDGXXLED (994), RDGXXLEDR (995), DGXXLEDRP (996), GXXLEDRP (997), PRDGXXLEDR (998), RDGXXLEDRP (999), DGXXLEDRP (1000), PRDGXXLEDRP (1001), RDGXXLEDRP (999), PRDGXXLEDRP (1001) |
| 27 | APG8c-pS138<br>X = Serine or Phosphoserine | RDGSX (1002), DGSXL (1003), GSXLE (1004), SXLED (1005), XLEDR (1006), PRDGSX (1007), RDGSXL (1008), DGSXLE (1009), GSXLED (1010), SXLEDR (1011), XLEDRP (1012), PRDGSXL (1013), RDGSXLE (1014), DGSXLED (1015), GSXLEDR (1016), SXLEDRP (1017), PRDGSXLE (1018), RDGSXLED (1019), DGSXLEDR (1020), GSXLEDRP (1021), PRDGSXLED (1022), RDGSXLEDR (1023), DGSXLEDRP (1024), PRDGSXLEDR (1025), RDGSXLEDRP (1026), PRDGSXLEDRP (1027) |
| 28 | APG9L1-pS14<br>X = Serine or Phosphoserine | RLEAX (1028), LEAXY (1029), EAXYS (1030), AXYSD (1031), XYSDS (1032), QRLEAX (1033), RLEAXY (1034), LEAXYS (1035), EAXYSD (1036), AXYSDS (1037), XYSDSP (1038), QRLEAXY (1039), RLEAXYS (1040), LEAXYSD (1041), EAXYSDS (1042), AXYSDSP (1043), QRLEAXYS (1044), RLEAXYSD (1045), LEAXYSDS (1046), EAXYSDSP (1047), QRLEAXYSD (1048), RLEAXYSDS (1049), LEAXYSDSP (1050), QRLEAXYSDS (1051), RLEAXYSDSP (1052), QRLEAXYSDSP (1053) |
| 29 | APG9L1-pY209<br>X = Tyrosine or Phosphotyrosine | ELDIX (1054), LDIXH (1055), DIXHR (1056), IXHRI (1057), XHRIL (1058), TELDIX (1059), ELDIXH (1060), LDIXHR (1061), DIXHRI (1062), IXHRIL (1063), XHRILR (1064), TELDIXH (1065), ELDIXHR (1066), LDIXHRI (1067), DIXHRIL (1068), IXHRILR (1069), TELDIXHR (1070), ELDIXHRI (1071), LDIXHRIL (1072), DIXHRILR (1073), TELDIXHRI (1074), ELDIXHRIL (1075), LDIXHRILR (1076), TELDIXHRIL (1077), ELDIXHRILR (1078), TELDIXHRILR (1079) |
| 30 | APG9L1-pS613<br>X = Serine or Phosphoserine | QSLQX (1080), SLQXE (1081), LQXES (1082), QXESE (1083), XESEP (1084), IQSLQX (1085), QSLQXE (1086), SLQXES (1087), LQXESE (1088), QXESEP (1089), XESEPL (1090), IQSLQXE (1091), QSLQXES (1092), SLQXESE (1093), LQXESEP (1094), QXESEPL (1095), IQSLQXES (1096), QSLQXESE (1097), SLQXESEP (1098), LQXESEPL (1099), IQSLQXESE (1100), QSLQXESEP (1101), SLQXESEPL (1102), IQSLQXESEP (1103), QSLQXESEPL (1104), IQSLQXESEPL (1105) |
| 31 | APG9L1-pS735<br>X = Serine or Phosphoserine | HRREX (1106), RREXD (1107), REXDE (1108), EXDES (1109), XDESG (1110), WHRREX (1111), HRREXD (1112), RREXDE (1113), REXDES (1114), EXDESG (1115), XDESGE (1116), WHRREXD (1117), HRREXDE (1118), RREXDES (1119), REXDESG (1120), EXDESGE (1121), WHRREXDE (1122), HRREXDES (1123), RREXDESG (1124), REXDESGE (1125), WHRREXDES (1126), HRREXDESG (1127), RREXDESGE (1128), WHRREXDESG (1129), HRREXDESGE (1130), WHRREXDESGE (1131) |
| 32 | APG9L1-pS738<br>X = Serine or Phosphoserine | ESDEX (1132), SDEXG (1133), DEXGE (1134), EXGES (1135), XGESA (1136), RESDEX (1137), ESDEXG (1138), SDEXGE (1139), DEXGES (1140), EXGESA (1141), XGESAP (1142), RESDEXG (1143), ESDEXGE (1144), SDEXGES (1145), DEXGESA (1146), EXGESAP (1147), RESDEXGE (1148), ESDEXGES (1149), SDEXGESA (1150), DEXGESAP (1151), RESDEXGES (1152), ESDEXGESA (1153), SDEXGESAP (1154), RESDEXGESA (1155), ESDEXGESAP (1156), RESDEXGESAP (1157) |
| 33 | APG9L1-pS741<br>X = Serine or Phosphoserine | ESGEX (1158), SGEXA (1159), GEXAP (1160), EXAPD (1161), XAPDE (1162), DESGEX (1163), ESGEXA (1164), SGEXAP (1165), GEXAPD (1166), EXAPDE (1167), XAPDEG (1168), DESGEXA (1169), ESGEXAP (1170), SGEXAPD (1171), GEXAPDE (1172), EXAPDEG (1173), DESGEXAP (1174), ESGEXAPD (1175), SGEXAPDE (1176), GEXAPDEG (1177), DESGEXAPD (1178), ESGEXAPDE (1179), SGEXAPDEG (1180), DESGEXAPDE (1181), ESGEXAPDEG (1182), DESGEXAPDEG (1183) |

TABLE 3-continued

Epitopes that include the phosphorylation site in autophagy proteins.

| PRODUCT NO | NAME | Sequence (SEQ ID NO) |
|---|---|---|
| 34 | APG9L1-pS828<br>X = Serine or<br>Phosphoserine | PEEGX (1184), EEGXE (1185), EGXED (1186), GXEDE (1187), XEDEL (1188), VPEEGX (1189), PEEGXE (1190), EEGXED (1191), EGXEDE (1192), GXEDEL (1193), XEDELP (1194), VPEEGXE (1195), PEEGXED (1196), EEGXEDE (1197), EGXEDEL (1198), GXEDELP (1199), VPEEGXED (1200), PEEGXEDE (1201), EEGXEDEL (1202), EGXEDELP (1203), VPEEGXEDE (1204), PEEGXEDEL (1205), EEGXEDELP (1206), VPEEGXEDEL (1207), PEEGXEDELP (1208), VPEEGXEDELP (1209) |
| 35 | APG10L-pS116<br>X = Serine or<br>Phosphoserine | YFRAX (1210), FRAXF (1211), RAXFL (1212), AXFLD (1213), XFLDG (1214), LYFRAX (1215), YFRAXF (1216), FRAXFL (1217), RAXFLD (1218), AXFLDG (1219), XFLDGR (1220), LYFRAXF (1221), YFRAXFL (1222), FRAXFLD (1223), RAXFLDG (1224), AXFLDGR (1225), LYFRAXFL (1226), YFRAXFLD (1227), FRAXFLDG (1228), RAXFLDGR (1229), LYFRAXFLD (1230), YFRAXFLDG (1231), FRAXFLDGR (1232), LYFRAXFLDG (1233), YFRAXFLDGR (1234), LYFRAXFLDGR (1235) |
| 36 | APG12L-pS26<br>X = Serine or<br>Phosphoserine | LTDVX (1236), TDVXP (1237), DVXPE (1238), VXPET (1239), XPETT (1240), GLTDVX (1241), LTDVXP (1242), TDVXPE (1243), DVXPET (1244), VXPETT (1245), XPETTT (1246), GLTDVXP (1247), LTDVXPE (1248), TDVXPET (1249), DVXPETT (1250), VXPETTT (1251), GLTDVXPE (1252), LTDVXPET (1253), TDVXPETT (1254), DVXPETTT (1255), GLTDVXPET (1256), LTDVXPETT (1257), TDVXPETTT (1258), GLTDVXPETT (1259), LTDVXPETTT (1260), GLTDVXPETTT (1261) |
| 37 | APG12L-pS41<br>X = Serine or<br>Phosphoserine | SAAVX (1262), AAVXP (1263), AVXPG (1264), VXPGT (1265), XPGTE (1266), SSAAVX (1267), SAAVXP (1268), AAVXPG (1269), AVXPGT (1270), VXPGTE (1271), XPGTEE (1272), SSAAVXP (1273), SAAVXPG (1274), AAVXPGT (1275), AVXPGTE (1276), VXPGTEE (1277), SSAAVXPG (1278), SAAVXPGT (1279), AAVXPGTE (1280), AVXPGTEE (1281), SSAAVXPGT (1282), SAAVXPGTE (1283), AAVXPGTEE (1284), SSAAVXPGTE (1285), SAAVXPGTEE (1286), SSAAVXPGTEE (1287) |
| 38 | APG16L-pS213<br>X = Serine or<br>Phosphoserine | NEKDX (1288), EKDXR (1289), KDXRR (1290), DXRRR (1291), XRRRQ (1292), ENEKDX (1293), NEKDXR (1294), EKDXRR (1295), KDXRRR (1296), DXRRRQ (1297), XRRRQA (1298), CENEKDX (1299), ENEKDXR (1300), NEKDXRR (1301), EKDXRRR (1302), KDXRRRQ (1303), DXRRRQA (1304), CENEKDXR (1305), ENEKDXRR (1306), NEKDXRRR (1307), EKDXRRRQ (1308), KDXRRRQA (1309), CENEKDXRR (1310), ENEKDXRRR (1311), NEKDXRRRQ (1312), EKDXRRRQA (1313), CENEKDXRRR (1314), ENEKDXRRRQ (1315), NEKDXRRRQA (1316), CENEKDXRRR (1317), ENEKDXRRRQ (1318), NEKDXRRRQA (1319), CENEKDXRRRQ (1320), ENEKDXRRRQA (1321), CENEKDXRRRQA (1322) |
| 39 | APG16L-pS287<br>X = Serine or<br>Phosphoserine | FGRRX (1323), GRRXV (1324), RRXVS (1325), RXVSS (1326), XVSSF (1327), IFGRRX (1328), FGRRXV (1329), GRRXVS (1330), RRXVSS (1331), RXVSSF (1332), XVSSFP (1333), IFGRRXV (1334), FGRRXVS (1335), GRRXVSS (1336), RRXVSSF (1337), RXVSSFP (1338), IFGRRXVS (1339), FGRRXVSS (1340), GRRXVSSF (1341), RRXVSSFP (1342), IFGRRXVSS (1343), FGRRXVSSF (1344), GRRXVSSFP (1345), IFGRRXVSSF (1346), FGRRXVSSFP (1347), IFGRRXVSSFP (1348) |
| 40 | APG16L-pS304<br>X = Serine or<br>Phosphoserine | THPGX (1349), HPGXG (1350), PGXGK (1351), GXGKE (1352), XGKEV (1353), DTHPGX (1354), THPGXG (1355), HPGXGK (1356), PGXGKE (1357), GXGKEV (1358), XGKEVR (1359), DTHPGXG (1360), THPGXGK (1361), HPGXGKE (1362), PGXGKEV (1363), GXGKEVR (1364), DTHPGXGK (1365), THPGXGKE (1366), HPGXGKEV (1367), PGXGKEVR (1368), DTHPGXGKE (1369), THPGXGKEV (1370), HPGXGKEVR (1371), DTHPGXGKEV (1372), THPGXGKEVR (1373), DTHPGXGKEVR (1374) |
| 41 | BECN1-pS64<br>X = Serine or<br>Phosphoserine | EETNX (1375), ETNXG (1376), TNXGE (1377), NXGEE (1378), XGEEP (1379), EEETNX (1380), EETNXG (1381), ETNXGE (1382), TNXGEE (1383), NXGEEP (1384), XGEEPF (1385), EEETNXG (1386), EETNXGE (1387), ETNXGEE (1388), TNXGEEP (1389), NXGEEPF (1390), EEETNXGE (1391), EETNXGEE (1392), ETNXGEEP (1393), TNXGEEPF (1394), EEETNXGEE (1395), EETNXGEEP (1396), ETNXGEEPF (1397), EEETNXGEEP (1398), EETNXGEEPF (1399), EEETNXGEEPF (1400) |

TABLE 3-continued

Epitopes that include the phosphorylation site in autophagy proteins.

| PRODUCT NO | NAME | Sequence (SEQ ID NO) |
|---|---|---|
| 42 | BECN1-pT72 X = Threonine or Phosphothreonine | PFIEX (1401), FIEXP (1402), IEXPR (1403), EXPRQ (1404), XPRQD (1405), EPFIEX (1406), PFIEXP (1407), FIEXPR (1408), IEXPRQ (1409), EXPRQD (1410), XPRQDG (1411), EPFIEXP (1412), PFIEXPR (1413), FIEXPRQ (1414), IEXPRQD (1415), EXPRQDG (1416), XPRQDGV (1417), EPFIEXPR (1418), PFIEXPRQ (1419), FIEXPRQD (1420), IEXPRQDG (1421), EXPRQDGV (1422), EPFIEXPRQ (1423), PFIEXPRQD (1424), FIEXPRQDG (1425), IEXPRQDGV (1426), EPFIEXPRQD (1427), PFIEXPRQDG (1428), FIEXPRQDGV (1429), EPFIEXPRQDG (1430), PFIEXPRQDGV (1431), EPFIEXPRQDGV (1432) |
| 43 | BECN1-pS249 X = Serine or Phosphoserine | DELKX (1433), ELKXV (1434), LKXVE (1435), KXVEN (1436), XVENQ (1437), DDELKX (1438), DELKXV (1439), ELKXVE (1440), LKXVEN (1441), KXVENQ (1442), XVENQM (1443), DDELKXV (1444), DELKXVE (1445), ELKXVEN (1446), LKXVENQ (1447), KXVENQM (1448), DDELKXVE (1449), DELKXVEN (1450), ELKXVENQ (1451), LKXVENQM (1452), DDELKXVEN (1453), DELKXVENQ (1454), ELKXVENQM (1455), DDELKXVENQ (1456), DELKXVENQM (1457), DDELKXVENQM (1458) |

TABLE 4

Epitopes that include the phosphorylation site in autophagy proteins.

| NO | PRODUCT NAME/ Phosphorylation Site | X equals | Sequence | SEQ ID NO |
|---|---|---|---|---|
| 1 | APG3L- Tyrosine 18 | Tyrosine or Phosphotyrosine | LEVAEXLTPVL | 401 |
| 2 | APG3L- Tyrosine 160 | Tyrosine or Phosphotyrosine | ADMEEXEESGL | 427 |
| 3 | APG4A- Serine 6 | Serine or Phosphoserine | MESVLXKYEDQ | 453 |
| 4 | APG4A- Serine 62 | Serine or Phosphoserine | YRRKFXPIGGT | 479 |
| 5 | APG4A- Serine 100 | Serine or Phosphoserine | LGRDWXWEKQK | 505 |
| 6 | APG4B- Serine 121 | Serine or Phosphoserine | IDRKDXYYSIH | 531 |
| 7 | APG4B- Serine 309 | Serine or Phosphoserine | PPCRMXIAELD | 557 |
| 8 | APG4C- Serine 166 | Serine or Phosphoserine | FEASLXGEREF | 583 |
| 9 | APG4C- Serine 177 | Serine or Phosphoserine | KTPTIXLKETI | 609 |
| 10 | APG4C- Serine 224 | Serine or Phosphoserine | EYGKKXGKKAG | 635 |
| 11 | APG4C- Serine 398 | Serine or Phosphoserine | DFKRAXEEITK | 661 |
| 12 | APG4C- Serine 408 | Serine or Phosphoserine | KMLKFXSKEKY | 687 |
| 13 | APG4C- Serine 451 | Serine or Phosphoserine | QLKRFXTEEFV | 713 |
| 14 | APG4D- Serine 15 | Serine or Phosphoserine | QYRSSXPEDAR | 739 |
| 15 | APG4D- Serine 341 | Serine or Phosphoserine | GKPRHXLYFIG | 765 |
| 16 | APG4D- Serine 467 | Serine or Phosphoserine | RAKRPXSEDFV | 791 |
| 17 | APG5L- Tyrosine 35 | Tyrosine or Phosphotyrosine | REAEPXYLLLP | 817 |
| 18 | APG5L- Serine 225 | Serine or Phosphoserine | KEVCPXAIDPE | 843 |
| 19 | APG7L- Serine 95 | Serine or Phosphoserine | TNTLEXFKTAD | 869 |
| 20 | APG7L- Serine 173 | Serine or Phosphoserine | LDQRFXLKQIE | 895 |
| 22 | APG8b- Tyrosine 12 | Tyrosine or Phosphotyrosine | TFKQRRXFEQRV | 927 |
| 23 | APG8b- Serine 101 | Serine or Phosphoserine | SEVYEXEKDED | 953 |

TABLE 4-continued

Epitopes that include the phosphorylation site in autophagy proteins.

| NO | PRODUCT NAME/ Phosphorylation Site | X equals | Sequence | SEQ ID NO |
|---|---|---|---|---|
| 25 | APG8c- Serine 137 | Serine or Phosphoserine | PRDGXSLEDRP | 978 |
| 26 | APG8c- Serine 137/138 | Serine or Phosphoserine | PRDGXXLEDRP | 1001 |
| 27 | APG8c- Serine 138 | Serine or Phosphoserine | PRDGSXLEDRP | 1027 |
| 28 | APG9L1- Serine 14 | Serine or Phosphoserine | QRLEAXYSDSP | 1053 |
| 29 | APG9L1- Tyrosine 209 | Tyrosine or Phosphotyrosine | TELDIXHRILR | 1079 |
| 30 | APG9L1- Serine 613 | Serine or Phosphoserine | IQSLQXESEPL | 1105 |
| 31 | APG9L1- Serine 735 | Serine or Phosphoserine | WHRREXDESGE | 1131 |
| 32 | APG9L1- Serine 738 | Serine or Phosphoserine | RESDEXGESAP | 1157 |
| 33 | APG9L1- Serine 741 | Serine or Phosphoserine | DESGEXAPDEG | 1183 |
| 34 | APG9L1- Serine 828 | Serine or Phosphoserine | VPEEGXEDELP | 1209 |
| 35 | APG10L- Serine 116 | Serine or Phosphoserine | LYFRAXFLDGR | 1235 |
| 36 | APG12L- Serine 26 | Serine or Phosphoserine | GLTDVXPETTT | 1261 |
| 37 | APG12L- Serine 41 | Serine or Phosphoserine | SSAAVXPGTEE | 1287 |
| 38 | APG16L- Serine 213 | Serine or Phosphoserine | CENEKDSRRQA | 25 |
| 39 | APG16L- Serine 287 | Serine or Phosphoserine | IFGRRXVSSFP | 1459 |
| 40 | APG16L- Serine 304 | Serine or Phosphoserine | DTHPGXGKEVR | 1374 |
| 41 | BECN1- Serine 64 | Serine or Phosphoserine | EEETNXGEEPF | 1460 |
| 42 | BECN1- Tyrosine 72 | Tyrosine or Phosphotyrosine | EPFIEXPRQDGV | 1461 |
| 43 | BECN1- Serine 249 | Serine or Phosphoserine | DDELKXVENQM | 1458 |

TABLE 5

Amino Acid Sequences Showing Phosphorylation Sites

| NO | Gene Name/ Phosphorylation Site | Sequence | SEQ ID NO |
|---|---|---|---|
| 1 | APG3L-pY18 | LEVAEYLTPVL | 1462 |
| 2 | APG3L-pY160 | ADMEEYEESGL | 1463 |
| 3 | APG4A-pS6 | MESVLSKYEDQ | 1464 |
| 4 | APG4A-pS62 | YRRKFSPIGGT | 1465 |
| 5 | APG4A-pS100 | LGRDWSWEKQK | 1466 |
| 6 | APG4B-pS121 | IDRKDSYYSIH | 1467 |
| 7 | APG4B-pS309 | PPCRMSIAELD | 1468 |
| 8 | APG4C-pS166 | FEASLSGEREF | 1469 |
| 9 | APG4C-pS177 | KTPTISLKETI | 1470 |
| 10 | APG4C-pS224 | EYGKKSGKKAG | 1471 |
| 11 | APG4C-pS398 | DFKRASEEITK | 1472 |
| 12 | APG4C-S408 | KMLKFSSKEKY | 1473 |
| 13 | APG4C-pS451 | QLKRFSTEEFV | 1474 |
| 14 | APG4D-S15 | QYRSSSPEDAR | 1475 |
| 15 | APG4D-pS341 | GKPRHSLYFIG | 1476 |
| 16 | APG4D-pS467 | RAKRPSSEDFV | 1477 |
| 17 | APG5L-pY35 | REAEPYYLLLP | 1478 |
| 18 | APG5L-pS225 | KEVCPSAIDPE | 1479 |
| 19 | APG7L-pS95 | TNTLESFKTAD | 1480 |
| 20 | APG7L-pS173 | LDQRFSLKQIE | 1481 |
| 22 | APG8b-pT12 | TFKQRRTFEQRV | 1482 |
| 23 | APG8b-pS101 | SEVYESEKDED | 1483 |
| 25 | APG8c-pS137 | PRDGSSLEDRP | 1484 |
| 26 | APG8c-pS137/138 | PRDGBSLEDRP | 1485 |

TABLE 5-continued

Amino Acid Sequences Showing Phosphorylation Sites

| NO | Gene Name/ Phosphorylation Site | Sequence | SEQ ID NO |
|---|---|---|---|
| 27 | APG8c-pS138 | PRDGSSLEDRP | 1486 |
| 28 | APG9L1-pS14 | QRLEASYSDSP | 1487 |
| 29 | APG9L1-pY209 | TELDIYHRILR | 1488 |
| 30 | APG9L1-pS613 | IQSLQSESEPL | 1489 |
| 31 | APG9L1-pS735 | WHRRESDESGE | 1490 |
| 32 | APG9L1-pS738 | RESDESGESAP | 1491 |
| 33 | APG9L1-pS741 | DESGESAPDEG | 1492 |
| 34 | APG9L1-pS828 | VPEEGSEDELP | 1493 |
| 35 | APG10L-pS116 | LYFRASFLDGR | 1494 |
| 36 | APG12L-pS26 | GLTDVSPETTT | 1495 |
| 37 | APG12L-pS41 | SSAAVSPGTEE | 1496 |
| 38 | APG16L-pS213 | CENEKDSRRQA | 25 |
| 39 | APG16L-pS287 | IFGRRSVSSFP | 1497 |
| 40 | APG16L-pS304 | DTHPGSGKEVR | 1498 |
| 41 | BECN1-pS64 | EEETNSGEEPF | 1499 |
| 42 | BECN1-pT72 | EPFIETPRQDGV | 1500 |
| 43 | BECN1-pS249 | DDELKSVENQM | 1501 |

REFERENCES

1: Bialik S, Kimchi A. "Autophagy and tumor suppression: recent advances in understanding the link between autophagic cell death pathways and tumor development." *Adv Exp Med Biol.* 2008; 615:177-200.

2: Obara K, Ohsumi Y. "Key questions about membrane dynamics during autophagy" *Seikagaku.* 2008 March; 80(3):215-23.

3: Liberski P P, Brown D R, Sikorska B, Caughey B, Brown P. "Cell death and autophagy in prion diseases (transmissible spongiform encephalopathies)." *Folia Neuropathol.* 2008; 46(1):1-25. Review.

4: Rajawat Y S, Bossis I. "Autophagy in aging and in neurodegenerative disorders." *Hormones (Athens).* 2008 January-March; 7(1):46-61.

5: Lerena C, Calligaris S D, Colombo M I. "Autophagy: for better or for worse, in good times or in bad times." *Curr. Mol. Med.* 2008 March; 8(2):92-101.

6: Galluzzi L, Vicencio J M, Kepp O, Tasdemir E, Maiuri M C, Kroemer G. "To die or not to die: that is the autophagic question." *Curr Mol Med.* 2008 March; 8(2):78-91.

7: Mizushima N, Levine B, Cuervo A M, Klionsky D J. "Autophagy fights disease through cellular self-digestion." *Nature.* 2008 Feb. 28; 451(7182):1069-75.

8: Lee H K, Iwasaki A. "Autophagy and antiviral immunity." *Curr Opin Immunol.* 2008 February; 20(1):23-9. Epub 2008 Feb. 8.

9: Lorin S, Codogno P, Djavaheri-Mergny M. "Autophagy: a new concept in cancer research" *Bull Cancer.* 2008 Jan. 1; 95(1):43-50.

10: Chu C T. "Eaten alive: autophagy and neuronal cell death after hypoxia-Ischemia." *Am J Pathol.* 2008 February; 172 (2):284-7. Epub 2008 Jan. 17. Review. No abstract available. Erratum in: Am J Pathol. 2008 April; 172(4):1153.

11: Levine B, Kroemer G. "Autophagy in the pathogenesis of disease." *Cell.* 2008 Jan. 11; 132(1):27-42.

12: Lefranc F, Facchini V, Kiss R. "Proautophagic drugs: a novel means to combat apoptosis-resistant cancers, with a special emphasis on glioblastomas." *Oncologist.* 2007 December; 12(12):1395-403.

13: McCray B A, Taylor J P. "The role of autophagy in age-related neurodegeneration." *Neurosignals.* 2008; 16(1):75-84. Epub 2007 Dec. 5.

14: Amaravadi R K, Thompson C B. "The roles of therapy-Induced autophagy and necrosis in cancer treatment."

*Clin Cancer Res.* 2007 Dec. 15; 13(24):7271-9.

15: Kundu M, Thompson C B. "Autophagy: basic principles and relevance to disease." *Annu Rev Pathol.* 2008; 3:427-55.

16: Nixon R A. "Autophagy, amyloidogenesis and Alzheimer disease." *J. Cell Sci.* 2007 Dec. 1; 120(Pt 23):4081-91.

17: Martinet W, Knaapen M W, Kockx M M, De Meyer G R. "Autophagy in cardiovascular disease." *Trends Mol. Med.* 2007 November; 13(11):482-91. Epub 2007 Oct. 29. Review.

18: Mizushima N. "Autophagy: process and function." *Genes Dev.* 2007 Nov. 15; 21(22):2861-73.

19: Thorburn A. "Apoptosis and autophagy: regulatory connections between two supposedly different processes." *Apoptosis.* 2008 January; 13(1):1-9.

20: Shacka J J, Roth K A, Zhang J. "The autophagy-lysosomal degradation pathway: role in neurodegenerative disease and therapy." *Front Biosci.* 2008 Jan. 1; 13:718-36.

21: Tanida, I., et al., "HsAtg4B/HsApg4B/autophagin-1 cleaves the carboxyl termini of three human Atg8 homologues and delipidates microtubule-associated protein light chain 3- and GABAA receptor-associated protein-phospholipid conjugates." *J. Biol. Chem.* 279(35):36268-36276 (2004).

22: He, H., et al., "Post-translational modifications of three members of the human MAP1LC3 family and detection of a novel type of modification for MAP1LC3B." *J. Biol. Chem.* 278(31):29278-29287 (2003).

23: Mann, S. S., et al., "Gene localization and developmental expression of light chain 3: a common subunit of microtubule-associated protein 1A (MAP1A) and MAP1B." *J. Neurosci. Res.* 43(5):535-544 (1996).

24: Baehrecke E H. "Autophagy: dual roles in life and death?" *Nat Rev Mol Cell Biol.* 6(6):505-10. (2005).

25: Lum J J, et al. "Autophagy in metazoans: cell survival in the land of plenty." *Nat Rev Mol Cell Biol.* 6(6):439-48. (2005).

26: Greenberg J T. "Degrade or die: a dual function for autophagy in the plant immune response." *Dev Cell.* 8(6): 799-801. (2005).

27: Shintani T and Klionsky D J. "Autophagy in health and disease: a double-edged sword." *Science.* 306(5698):990-5. (2004).

28: Tanida I., et al. "LC3 conjugation system in mammalian autophagy." *Int. J. Biochem. Cell Biol.* 36:2503-2518 (2004).

SEQUENCE LISTING (1501 sequences)

SEQ ID NO: 1 - protein, 5 aa, Artificial Sequence
  Synthetic peptide
KFERQ

SEQ ID NO: 2 - protein, 12 aa, Artificial Sequence
  Synthetic amino acid phospho-peptide antigen
  misc_feature (6)..(6): Tyr is phosphotyrosine
LEVAEYLTPVLC

SEQ ID NO: 3 - protein, 12 aa, Artificial Sequence
  Synthetic amino acid phospho-peptide antigen
LEVAEYLTPVLC

SEQ ID NO: 4 - protein, 12 aa, Artificial Sequence
  Synthetic amino acid phospho-peptide antigen
  misc_feature (6)..(6): Ser is phosphoserine
LGRDWSWEKQKC

SEQ ID NO: 5 - protein, 12 aa, Artificial Sequence
  Synthetic amino acid phospho-peptide antigen
LGRDWSWEKQKC

SEQ ID NO: 6 - protein, 12 aa, Artificial Sequence
  Synthetic amino acid phospho-peptide antigen
  misc_feature (6)..(6): Ser is phosphoserine
FEASLSGEREFC

SEQ ID NO: 7 - protein, 12 aa, Artificial Sequence
  Synthetic amino acid phospho-peptide antigen
FEASLSGEREFC

SEQ ID NO: 8 - protein, 12 aa, Artificial Sequence
  Synthetic amino acid phospho-peptide antigen
  misc_feature (6)..(6): Ser is phosphoserine
KTPTISLKETIC

SEQ ID NO: 9 - protein, 12 aa, Artificial Sequence
  Synthetic amino acid phospho-peptide antigen
KTPTISLKETIC

SEQ ID NO: 10 - protein, 12 aa, Artificial Sequence
  Synthetic amino acid phospho-peptide antigen
  misc_feature (7)..(7): Ser is phosphoserine
CDFKRASEEITK

SEQ ID NO: 11 - protein, 12 aa, Artificial Sequence
  Synthetic amino acid phospho-peptide antigen
CDFKRASEEITK

SEQ ID NO: 12 - protein, 12 aa, Artificial Sequence
  Synthetic amino acid phospho-peptide antigen
  misc_feature (7)..(7): Ser is phosphoserine
CQLKRFSTEEFV

SEQ ID NO: 13 - protein, 12 aa, Artificial Sequence
  Synthetic amino acid phospho-peptide antigen
CQLKRFSTEEFV

SEQ ID NO: 14 - protein, 12 aa, Artificial Sequence
  Synthetic amino acid phospho-peptide antigen
  misc_feature (6)..(6): Ser is phosphoserine
QYRSSSPEDARC

SEQ ID NO: 15 - protein, 12 aa, Artificial Sequence
  Synthetic amino acid phospho-peptide antigen
QYRSSSPEDARC

SEQ ID NO: 16 - protein, 12 aa, Artificial Sequence
  Synthetic amino acid phospho-peptide antigen
  misc_feature (7)..(7): Ser is phosphoserine
CGKPRHSLYFIG

SEQ ID NO: 17 - protein, 12 aa, Artificial Sequence
  Synthetic amino acid phospho-peptide antigen
CGKPRHSLYFIG

SEQ ID NO: 18 - protein, 12 aa, Artificial Sequence
  Synthetic amino acid phospho-peptide antigen
  misc_feature (7)..(7): Ser is phosphoserine
CRAKRPSSEDFV

SEQ ID NO: 19 - protein, 12 aa, Artificial Sequence
  Synthetic amino acid phospho-peptide antigen
CRAKRPSSEDFV

SEQ ID NO: 20 - protein, 12 aa, Artificial Sequence
  Synthetic amino acid phospho-peptide antigen
  misc_feature (6)..(6): Ser is phosphoserine
TNTLESFKTADC

SEQ ID NO: 21 - protein, 12 aa, Artificial Sequence
  Synthetic amino acid phospho-peptide antigen
TNTLESFKTADC

SEQ ID NO: 22 - protein, 12 aa, Artificial Sequence
  Synthetic amino acid phospho-peptide antigen
  misc_feature (6)..(6): Ser is phosphoserine
WHRRESDESGEC

SEQ ID NO: 23 - protein, 12 aa, Artificial Sequence
  Synthetic amino acid phospho-peptide antigen
WHRRESDESGEC

SEQ ID NO: 24 - protein, 12 aa, Artificial Sequence
  Synthetic amino acid phospho-peptide antigen
  misc_feature (7)..(7): Ser is phosphoserine
CENEKDSRRRQA

SEQ ID NO: 25 - protein, 12 aa, Artificial Sequence
  Synthetic amino acid phospho-peptide antigen
CENEKDSRRRQA

SEQ ID NO: 26 - protein, 12 aa, Artificial Sequence
  Synthetic amino acid phospho-peptide antigen
  misc_feature (6)..(6): Ser is phosphoserine
IFGRRSVSSFPC

SEQ ID NO: 27 - protein, 12 aa, Artificial Sequence
  Synthetic amino acid phospho-peptide antigen
IFGRRSVSSFPC

SEQ ID NO: 28 - protein, 4 aa, Artificial Sequence
  Synthetic peptide
  misc_feature (4)..(4): Xaa is Tyrosine or Phosphotyrosine
VAEX

SEQ ID NO: 29 - protein, 4 aa, Artificial Sequence
  Synthetic peptide
  misc_feature (3)..(3): Xaa is Tyrosine or Phosphotyrosine
AEXL

SEQ ID NO: 30 - protein, 4 aa, Artificial Sequence
  Synthetic peptide
  misc_feature (2)..(2): Xaa is Tyrosine or Phosphotyrosine
EXLT

SEQ ID NO: 31 - protein, 4 aa, Artificial Sequence
  Synthetic peptide
  misc_feature (1)..(1): Xaa is Tyrosine or Phosphotyrosine
XLTP

SEQ ID NO: 32 - protein, 4 aa, Artificial Sequence
  Synthetic peptide
  misc_feature (4)..(4): Xaa is Tyrosine or Phosphotyrosine
MEEX

SEQ ID NO: 33 - protein, 4 aa, Artificial Sequence
  Synthetic peptide
  misc_feature (3)..(3): Xaa is Tyrosine or Phosphotyrosine
EEXE

SEQ ID NO: 34 - protein, 4 aa, Artificial Sequence
  Synthetic peptide
  misc_feature (2)..(2): Xaa is Tyrosine or Phosphotyrosine
EXEE

SEQ ID NO: 35 - protein, 4 aa, Artificial Sequence
  Synthetic peptide
  misc_feature (1)..(1): Xaa is Tyrosine or Phosphotyrosine
XEES

SEQ ID NO: 36 - protein, 4 aa, Artificial Sequence
  Synthetic peptide
  misc_feature (4)..(4): Xaa is Serine or Phosphoserine
SVLX

SEQ ID NO: 37 - protein, 4 aa, Artificial Sequence
  Synthetic peptide
  misc_feature (3)..(3): Xaa is Serine or Phosphoserine
VLXK

SEQ ID NO: 38 - protein, 4 aa, Artificial Sequence
  Synthetic peptide
  misc_feature (2)..(2): Xaa is Serine or Phosphoserine
LXKY

SEQ ID NO: 39 - protein, 4 aa, Artificial Sequence
  Synthetic peptide
  misc_feature (1)..(1): Xaa is Serine or Phosphoserine
XKYE

SEQ ID NO: 40 - protein, 4 aa, Artificial Sequence
  Synthetic peptide
  misc_feature (4)..(4): Xaa is Serine or Phosphoserine
RKFX

SEQ ID NO: 41 - protein, 4 aa, Artificial Sequence
  Synthetic peptide
  misc_feature (3)..(3): Xaa is Serine or Phosphoserine
KFXP

SEQ ID NO: 42 - protein, 4 aa, Artificial Sequence
  Synthetic peptide
  misc_feature (2)..(2): Xaa is Serine or Phosphoserine
FXPI

SEQ ID NO: 43 - protein, 4 aa, Artificial Sequence
  Synthetic peptide
  misc_feature (1)..(1): Xaa is Serine or Phosphoserine
XPIG

SEQ ID NO: 44 - protein, 4 aa, Artificial Sequence
  Synthetic peptide
  misc_feature (4)..(4): Xaa is Serine or Phosphoserine
RDWX

SEQ ID NO: 45 - protein, 4 aa, Artificial Sequence
  Synthetic peptide
  misc_feature (3)..(3): Xaa is Serine or Phosphoserine
DWXW

SEQ ID NO: 46 - protein, 4 aa, Artificial Sequence
  Synthetic peptide
  misc_feature (2)..(2): Xaa is Serine or Phosphoserine
WXWE

SEQ ID NO: 47 - protein, 4 aa, Artificial Sequence
  Synthetic peptide
  misc_feature (1)..(1): Xaa is Serine or Phosphoserine
XWEK

SEQ ID NO: 48 - protein, 4 aa, Artificial Sequence
  Synthetic peptide
  misc_feature (4)..(4): Xaa is Serine or Phosphoserine
RKDX

SEQ ID NO: 49 - protein, 4 aa, Artificial Sequence
  Synthetic peptide
  misc_feature (3)..(3): Xaa is Serine or Phosphoserine
KDXY

SEQ ID NO: 50 - protein, 4 aa, Artificial Sequence
  Synthetic peptide
  misc_feature (2)..(2): Xaa is Serine or Phosphoserine
DXYY

SEQ ID NO: 51 - protein, 4 aa, Artificial Sequence
  Synthetic peptide
  misc_feature (1)..(1): Xaa is Serine or Phosphoserine
XYYS

SEQ ID NO: 52 - protein, 4 aa, Artificial Sequence
  Synthetic peptide
  misc_feature (4)..(4): Xaa is Serine or Phosphoserine
CRMX

SEQ ID NO: 53 - protein, 4 aa, Artificial Sequence
  Synthetic peptide
  misc_feature (3)..(3): Xaa is Serine or Phosphoserine
RMXI

SEQ ID NO: 54 - protein, 4 aa, Artificial Sequence
  Synthetic peptide
  misc_feature (2)..(2): Xaa is Serine or Phosphoserine
MXIA

SEQ ID NO: 55 - protein, 4 aa, Artificial Sequence
  Synthetic peptide
  misc_feature (1)..(1): Xaa is Serine or Phosphoserine
XIAE

SEQ ID NO: 56 - protein, 4 aa, Artificial Sequence
  Synthetic peptide
  misc_feature (4)..(4): Xaa is Serine or Phosphoserine
ASLX

SEQ ID NO: 57 - protein, 4 aa, Artificial Sequence
  Synthetic peptide
  misc_feature (3)..(3): Xaa is Serine or Phosphoserine
SLXG

SEQ ID NO: 58 - protein, 4 aa, Artificial Sequence
  Synthetic peptide
  misc_feature (2)..(2): Xaa is Serine or Phosphoserine
LXGE

SEQ ID NO: 59 - protein, 4 aa, Artificial Sequence
  Synthetic peptide
  misc_feature (1)..(1): Xaa is Serine or Phosphoserine
XGER

SEQ ID NO: 60 - protein, 4 aa, Artificial Sequence
  Synthetic peptide
  misc_feature (4)..(4): Xaa is Serine or Phosphoserine
PTIX

SEQ ID NO: 61 - protein, 4 aa, Artificial Sequence
  Synthetic peptide
  misc_feature (3)..(3): Xaa is Serine or Phosphoserine
TIXL

SEQ ID NO: 62 - protein, 4 aa, Artificial Sequence
  Synthetic peptide
  misc_feature (2)..(2): Xaa is Serine or Phosphoserine
IXLK

SEQ ID NO: 63 - protein, 4 aa, Artificial Sequence
  Synthetic peptide
  misc_feature (1)..(1): Xaa is Serine or Phosphoserine
XLKE

SEQ ID NO: 64 - protein, 4 aa, Artificial Sequence
  Synthetic peptide
  misc_feature (4)..(4): Xaa is Serine or Phosphoserine
GKKX

SEQ ID NO: 65 - protein, 4 aa, Artificial Sequence
  Synthetic peptide
  misc_feature (3)..(3): Xaa is Serine or Phosphoserine
KKXG

SEQ ID NO: 66 - protein, 4 aa, Artificial Sequence
  Synthetic peptide
  misc_feature (2)..(2): Xaa is Serine or Phosphoserine
KXGK

SEQ ID NO: 67 - protein, 4 aa, Artificial Sequence
  Synthetic peptide
  misc_feature (1)..(1): Xaa is Serine or Phosphoserine
XGKK

SEQ ID NO: 68 - protein, 4 aa, Artificial Sequence
  Synthetic peptide
  misc_feature (4)..(4): Xaa is Serine or Phosphoserine
KRAX

SEQ ID NO: 69 - protein, 4 aa, Artificial Sequence
  Synthetic peptide
  misc_feature (3)..(3): Xaa is Serine or Phosphoserine
RAXE

SEQ ID NO: 70 - protein, 4 aa, Artificial Sequence
  Synthetic peptide
  misc_feature (2)..(2): Xaa is Serine or Phosphoserine
AXEE

SEQ ID NO: 71 - protein, 4 aa, Artificial Sequence
  Synthetic peptide
  misc_feature (1)..(1): Xaa is Serine or Phosphoserine
XEEI

SEQ ID NO: 72 - protein, 4 aa, Artificial Sequence
  Synthetic peptide
  misc_feature (4)..(4): Xaa is Serine or Phosphoserine
LKFX

SEQ ID NO: 73 - protein, 4 aa, Artificial Sequence
  Synthetic peptide
  misc_feature (3)..(3): Xaa is Serine or Phosphoserine
KFXS

SEQ ID NO: 74 - protein, 4 aa, Artificial Sequence
  Synthetic peptide
  misc_feature (2)..(2): Xaa is Serine or Phosphoserine
FXSK

SEQ ID NO: 75 - protein, 4 aa, Artificial Sequence
  Synthetic peptide
  misc_feature (1)..(1): Xaa is Serine or Phosphoserine
XSKE

SEQ ID NO: 76 - protein, 4 aa, Artificial Sequence
  Synthetic peptide
  misc_feature (4)..(4): Xaa is Serine or Phosphoserine
KRFX

SEQ ID NO: 77 - protein, 4 aa, Artificial Sequence
  Synthetic peptide
  misc_feature (3)..(3): Xaa is Serine or Phosphoserine
RFXT

SEQ ID NO: 78 - protein, 4 aa, Artificial Sequence
  Synthetic peptide
  misc_feature (2)..(2): Xaa is Serine or Phosphoserine
FXTE

SEQ ID NO: 79 - protein, 4 aa, Artificial Sequence
  Synthetic peptide
  misc_feature (1)..(1): Xaa is Serine or Phosphoserine
XTEE

SEQ ID NO: 80 - protein, 4 aa, Artificial Sequence
  Synthetic peptide
  misc_feature (4)..(4): Xaa is Serine or Phosphoserine
RSSX

SEQ ID NO: 81 - protein, 4 aa, Artificial Sequence
  Synthetic peptide
  misc_feature (3)..(3): Xaa is Serine or Phosphoserine
SSXP

SEQ ID NO: 82 - protein, 4 aa, Artificial Sequence
  Synthetic peptide
  misc_feature (2)..(2): Xaa is Serine or Phosphoserine
SXPE

SEQ ID NO: 83 - protein, 4 aa, Artificial Sequence
  Synthetic peptide
  misc_feature (1)..(1): Xaa is Serine or Phosphoserine
XPED

SEQ ID NO: 84 - protein, 4 aa, Artificial Sequence
  Synthetic peptide
  misc_feature (4)..(4): Xaa is Serine or Phosphoserine
PRHX

SEQ ID NO: 85 - protein, 4 aa, Artificial Sequence
  Synthetic peptide
  misc_feature (3)..(3): Xaa is Serine or Phosphoserine
RHXL

SEQ ID NO: 86 - protein, 4 aa, Artificial Sequence
  Synthetic peptide
  misc_feature (2)..(2): Xaa is Serine or Phosphoserine
HXLY

SEQ ID NO: 87 - protein, 4 aa, Artificial Sequence
  Synthetic peptide
  misc_feature (1)..(1): Xaa is Serine or Phosphoserine
XLYF

SEQ ID NO: 88 - protein, 4 aa, Artificial Sequence
  Synthetic peptide
  misc_feature (4)..(4): Xaa is Serine or Phosphoserine
KRPX

SEQ ID NO: 89 - protein, 4 aa, Artificial Sequence
  Synthetic peptide
  misc_feature (3)..(3): Xaa is Serine or Phosphoserine
RPXS

SEQ ID NO: 90 - protein, 4 aa, Artificial Sequence
  Synthetic peptide
  misc_feature (2)..(2): Xaa is Serine or Phosphoserine
PXSE

SEQ ID NO: 91 - protein, 4 aa, Artificial Sequence
  Synthetic peptide
  misc_feature (1)..(1): Xaa is Serine or Phosphoserine
XSED

SEQ ID NO: 92 - protein, 4 aa, Artificial Sequence
  Synthetic peptide
  misc_feature (4)..(4): Xaa is Tyrosine or Phosphotyrosine
AEPX

SEQ ID NO: 93 - protein, 4 aa, Artificial Sequence
  Synthetic peptide
  misc_feature (3)..(3): Xaa is Tyrosine or Phosphotyrosine
EPXY

SEQ ID NO: 94 - protein, 4 aa, Artificial Sequence
  Synthetic peptide
  misc_feature (2)..(2): Xaa is Tyrosine or Phosphotyrosine
PXYL

SEQ ID NO: 95 - protein, 4 aa, Artificial Sequence
  Synthetic peptide
  misc_feature (1)..(1): Xaa is Tyrosine or Phosphotyrosine
XYLL

SEQ ID NO: 96 - protein, 4 aa, Artificial Sequence
  Synthetic peptide
  misc_feature (4)..(4): Xaa is Serine or Phosphoserine
VCPX

SEQ ID NO: 97 - protein, 4 aa, Artificial Sequence
  Synthetic peptide
  misc_feature (3)..(3): Xaa is Serine or Phosphoserine
CPXA

SEQ ID NO: 98 - protein, 4 aa, Artificial Sequence
  Synthetic peptide
  misc_feature (2)..(2): Xaa is Serine or Phosphoserine
PXAI

SEQ ID NO: 99 - protein, 4 aa, Artificial Sequence
  Synthetic peptide
  misc_feature (1)..(1): Xaa is Serine or Phosphoserine
XAID

SEQ ID NO: 100 - protein, 4 aa, Artificial Sequence
  Synthetic peptide
  misc_feature (4)..(4): Xaa is Serine or Phosphoserine
TLEX

SEQ ID NO: 101 - protein, 4 aa, Artificial Sequence
  Synthetic peptide
  misc_feature (3)..(3): Xaa is Serine or Phosphoserine
LEXF

SEQ ID NO: 102 - protein, 4 aa, Artificial Sequence
  Synthetic peptide
  misc_feature (2)..(2): Xaa is Serine or Phosphoserine
EXFK

SEQ ID NO: 103 - protein, 4 aa, Artificial Sequence
  Synthetic peptide
  misc_feature (1)..(1): Xaa is Serine or Phosphoserine
XFKT

SEQ ID NO: 104 - protein, 4 aa, Artificial Sequence
  Synthetic peptide
  misc_feature (4)..(4): Xaa is Serine or Phosphoserine
QRFX

SEQ ID NO: 105 - protein, 4 aa, Artificial Sequence
  Synthetic peptide
  misc_feature (3)..(3): Xaa is Serine or Phosphoserine
RFXL

SEQ ID NO: 106 - protein, 4 aa, Artificial Sequence
  Synthetic peptide
  misc_feature (2)..(2): Xaa is Serine or Phosphoserine
FXLK

SEQ ID NO: 107 - protein, 4 aa, Artificial Sequence
  Synthetic peptide
  misc_feature (1)..(1): Xaa is Serine or Phosphoserine
XLKQ

SEQ ID NO: 108 - protein, 4 aa, Artificial Sequence
  Synthetic peptide
  misc_feature (4)..(4): Xaa is Threonine or Phosphothreonine
QRRX

SEQ ID NO: 109 - protein, 4 aa, Artificial Sequence
  Synthetic peptide
  misc_feature (3)..(3): Xaa is Threonine or Phosphothreonine
RRXF

SEQ ID NO: 110 - protein, 4 aa, Artificial Sequence
  Synthetic peptide
  misc_feature (2)..(2): Xaa is Threonine or Phosphothreonine
RXFE

SEQ ID NO: 111 - protein, 4 aa, Artificial Sequence
  Synthetic peptide
  misc_feature (1)..(1): Xaa is Threonine or Phosphothreonine
XFEQ

SEQ ID NO: 112 - protein, 4 aa, Artificial Sequence
  Synthetic peptide
  misc_feature (4)..(4): Xaa is Serine or Phosphoserine
VYEX

SEQ ID NO: 113 - protein, 4 aa, Artificial Sequence
  Synthetic peptide
  misc_feature (3)..(3): Xaa is Serine or Phosphoserine
YEXE

SEQ ID NO: 114 - protein, 4 aa, Artificial Sequence
  Synthetic peptide
  misc_feature (2)..(2): Xaa is Serine or Phosphoserine
EXEK

SEQ ID NO: 115 - protein, 4 aa, Artificial Sequence
  Synthetic peptide
  misc_feature (1)..(1): Xaa is Serine or Phosphoserine
XEKD

SEQ ID NO: 116 - protein, 4 aa, Artificial Sequence
  Synthetic peptide
  misc_feature (4)..(4): Xaa is Serine or Phosphoserine
RDGX

SEQ ID NO: 117 - protein, 4 aa, Artificial Sequence
  Synthetic peptide
  misc_feature (3)..(3): Xaa is Serine or Phosphoserine
DGXS

SEQ ID NO: 118 - protein, 4 aa, Artificial Sequence
  Synthetic peptide
  misc_feature (2)..(2): Xaa is Serine or Phosphoserine
GXSL

SEQ ID NO: 119 - protein, 4 aa, Artificial Sequence
  Synthetic peptide
  misc_feature (1)..(1): Xaa is Serine or Phosphoserine
XSLE

SEQ ID NO: 120 - protein, 5 aa, Artificial Sequence
  Synthetic peptide
  misc_feature (4)..(5): Xaa is Serine or Phosphoserine
RDGXX

SEQ ID NO: 121 - protein, 5 aa, Artificial Sequence
  Synthetic peptide
  misc_feature (3)..(4): Xaa is Serine or Phosphoserine
DGXXL

SEQ ID NO: 122 - protein, 5 aa, Artificial Sequence
  Synthetic peptide
  misc_feature (2)..(3): Xaa is Serine or Phosphoserine
GXXLE

SEQ ID NO: 123 - protein, 5 aa, Artificial Sequence
  Synthetic peptide
  misc_feature (1)..(2): Xaa is Serine or Phosphoserine
XXLED

SEQ ID NO: 124 - protein, 4 aa, Artificial Sequence
  Synthetic peptide
  misc_feature (4)..(4): Xaa is Serine or Phosphoserine
DGSX

SEQ ID NO: 125 - protein, 4 aa, Artificial Sequence
  Synthetic peptide
  misc_feature (3)..(3): Xaa is Serine or Phosphoserine
GSXL

SEQ ID NO: 126 - protein, 4 aa, Artificial Sequence
  Synthetic peptide
  misc_feature (2)..(2): Xaa is Serine or Phosphoserine
SXLE

SEQ ID NO: 127 - protein, 4 aa, Artificial Sequence
  Synthetic peptide
  misc_feature (1)..(1): Xaa is Serine or Phosphoserine
XLED

SEQ ID NO: 128 - protein, 4 aa, Artificial Sequence
  Synthetic peptide
  misc_feature (4)..(4): Xaa is Serine or Phosphoserine
LEAX

SEQ ID NO: 129 - protein, 4 aa, Artificial Sequence
  Synthetic peptide
  misc_feature (3)..(3): Xaa is Serine or Phosphoserine
EAXY

SEQ ID NO: 130 - protein, 4 aa, Artificial Sequence
  Synthetic peptide
  misc_feature (2)..(2): Xaa is Serine or Phosphoserine
AXYS

SEQ ID NO: 131 - protein, 4 aa, Artificial Sequence
  Synthetic peptide
  misc_feature (1)..(1): Xaa is Serine or Phosphoserine
XYSD

SEQ ID NO: 132 - protein, 4 aa, Artificial Sequence
  Synthetic peptide
  misc_feature (4)..(4): Xaa is Tyrosine or Phosphotyrosine
LDIX

SEQ ID NO: 133 - protein, 4 aa, Artificial Sequence
  Synthetic peptide
  misc_feature (3)..(3): Xaa is Tyrosine or Phosphotyrosine
DIXH

SEQ ID NO: 134 - protein, 4 aa, Artificial Sequence
  Synthetic peptide
  misc_feature (2)..(2): Xaa is Tyrosine or Phosphotyrosine
IXHR

SEQ ID NO: 135 - protein, 4 aa, Artificial Sequence
  Synthetic peptide
  misc_feature (1)..(1): Xaa is Tyrosine or Phosphotyrosine
XHRI

SEQ ID NO: 136 - protein, 4 aa, Artificial Sequence
  Synthetic peptide
  misc_feature (4)..(4): Xaa is Serine or Phosphoserine
SLQX

SEQ ID NO: 137 - protein, 4 aa, Artificial Sequence
  Synthetic peptide
  misc_feature (3)..(3): Xaa is Serine or Phosphoserine
LQXE

SEQ ID NO: 138 - protein, 4 aa, Artificial Sequence
  Synthetic peptide
  misc_feature (2)..(2): Xaa is Serine or Phosphoserine
QXES

SEQ ID NO: 139 - protein, 4 aa, Artificial Sequence
  Synthetic peptide
  misc_feature (1)..(1): Xaa is Serine or Phosphoserine
XESE

SEQ ID NO: 140 - protein, 4 aa, Artificial Sequence
  Synthetic peptide
  misc_feature (4)..(4): Xaa is Serine or Phosphoserine
RREX

SEQ ID NO: 141 - protein, 4 aa, Artificial Sequence
  Synthetic peptide
  misc_feature (3)..(3): Xaa is Serine or Phosphoserine
REXD

SEQ ID NO: 142 - protein, 4 aa, Artificial Sequence
  Synthetic peptide
  misc_feature (2)..(2): Xaa is Serine or Phosphoserine
EXDE

SEQ ID NO: 143 - protein, 4 aa, Artificial Sequence
  Synthetic peptide
  misc_feature (1)..(1): Xaa is Serine or Phosphoserine
XDES

SEQ ID NO: 144 - protein, 4 aa, Artificial Sequence
  Synthetic peptide
  misc_feature (4)..(4): Xaa is Serine or Phosphoserine
SDEX

SEQ ID NO: 145 - protein, 4 aa, Artificial Sequence
  Synthetic peptide
  misc_feature (3)..(3): Xaa is Serine or Phosphoserine
DEXG

SEQ ID NO: 146 - protein, 4 aa, Artificial Sequence
  Synthetic peptide
  misc_feature (2)..(2): Xaa is Serine or Phosphoserine
EXGE

SEQ ID NO: 147 - protein, 4 aa, Artificial Sequence
  Synthetic peptide
  misc_feature (1)..(1): Xaa is Serine or Phosphoserine
XGES

SEQ ID NO: 148 - protein, 4 aa, Artificial Sequence
  Synthetic peptide
  misc_feature (4)..(4): Xaa is Serine or Phosphoserine
SGEX

SEQ ID NO: 149 - protein, 4 aa, Artificial Sequence
  Synthetic peptide
  misc_feature (3)..(3): Xaa is Serine or Phosphoserine
GEXA

SEQ ID NO: 150 - protein, 4 aa, Artificial Sequence
  Synthetic peptide
  misc_feature (2)..(2): Xaa is Serine or Phosphoserine
EXAP

SEQ ID NO: 151 - protein, 4 aa, Artificial Sequence
  Synthetic peptide
  misc_feature (1)..(1): Xaa is Serine or Phosphoserine
XAPD

SEQ ID NO: 152 - protein, 4 aa, Artificial Sequence
  Synthetic peptide
  misc_feature (4)..(4): Xaa is Serine or Phosphoserine
EEGX

SEQ ID NO: 153 - protein, 4 aa, Artificial Sequence
  Synthetic peptide
  misc_feature (3)..(3): Xaa is Serine or Phosphoserine
EGXE

SEQ ID NO: 154 - protein, 4 aa, Artificial Sequence
  Synthetic peptide
  misc_feature (2)..(2): Xaa is Serine or Phosphoserine
GXED

SEQ ID NO: 155 - protein, 4 aa, Artificial Sequence
  Synthetic peptide
  misc_feature (1)..(1): Xaa is Serine or Phosphoserine
XEDE

SEQ ID NO: 156 - protein, 4 aa, Artificial Sequence
  Synthetic peptide
  misc_feature (4)..(4): Xaa is Serine or Phosphoserine
FRAX

SEQ ID NO: 157 - protein, 4 aa, Artificial Sequence
  Synthetic peptide
  misc_feature (3)..(3): Xaa is Serine or Phosphoserine
RAXF

SEQ ID NO: 158 - protein, 4 aa, Artificial Sequence
  Synthetic peptide
  misc_feature (2)..(2): Xaa is Serine or Phosphoserine
AXFL

SEQ ID NO: 159 - protein, 4 aa, Artificial Sequence
  Synthetic peptide
  misc_feature (1)..(1): Xaa is Serine or Phosphoserine
XFLD

SEQ ID NO: 160 - protein, 4 aa, Artificial Sequence
  Synthetic peptide
  misc_feature (4)..(4): Xaa is Serine or Phosphoserine
TDVX

SEQ ID NO: 161 - protein, 4 aa, Artificial Sequence
  Synthetic peptide
  misc_feature (3)..(3): Xaa is Serine or Phosphoserine
DVXP

SEQ ID NO: 162 - protein, 4 aa, Artificial Sequence
  Synthetic peptide
  misc_feature (2)..(2): Xaa is Serine or Phosphoserine
VXPE

SEQ ID NO: 163 - protein, 4 aa, Artificial Sequence
  Synthetic peptide
  misc_feature (1)..(1): Xaa is Serine or Phosphoserine
XPET

SEQ ID NO: 164 - protein, 4 aa, Artificial Sequence
  Synthetic peptide
  misc_feature (4)..(4): Xaa is Serine or Phosphoserine
AAVX

SEQ ID NO: 165 - protein, 4 aa, Artificial Sequence
  Synthetic peptide
  misc_feature (3)..(3): Xaa is Serine or Phosphoserine
AVXP

SEQ ID NO: 166 - protein, 4 aa, Artificial Sequence
  Synthetic peptide
  misc_feature (2)..(2): Xaa is Serine or Phosphoserine
VXPG

SEQ ID NO: 167 - protein, 4 aa, Artificial Sequence
  Synthetic peptide
  misc_feature (1)..(1): Xaa is Serine or Phosphoserine
XPGT

SEQ ID NO: 168 - protein, 4 aa, Artificial Sequence
  Synthetic peptide
  misc_feature (4)..(4): Xaa is Serine or Phosphoserine
EKDX

SEQ ID NO: 169 - protein, 4 aa, Artificial Sequence
  Synthetic peptide
  misc_feature (3)..(3): Xaa is Serine or Phosphoserine
KDXR

SEQ ID NO: 170 - protein, 4 aa, Artificial Sequence
  Synthetic peptide
  misc_feature (2)..(2): Xaa is Serine or Phosphoserine
DXRR

SEQ ID NO: 171 - protein, 4 aa, Artificial Sequence
  Synthetic peptide
  misc_feature (1)..(1): Xaa is Serine or Phosphoserine
XRRR

SEQ ID NO: 172 - protein, 4 aa, Artificial Sequence
  Synthetic peptide
  misc_feature (4)..(4): Xaa is Serine or Phosphoserine
GRRX

SEQ ID NO: 173 - protein, 4 aa, Artificial Sequence
  Synthetic peptide
  misc_feature (3)..(3): Xaa is Serine or Phosphoserine
RRXV

SEQ ID NO: 174 - protein, 4 aa, Artificial Sequence
  Synthetic peptide
  misc_feature (2)..(2): Xaa is Serine or Phosphoserine
RXVS

SEQ ID NO: 175 - protein, 4 aa, Artificial Sequence
  Synthetic peptide
  misc_feature (1)..(1): Xaa is Serine or Phosphoserine
XVSS

SEQ ID NO: 176 - protein, 4 aa, Artificial Sequence
  Synthetic peptide
  misc_feature (4)..(4): Xaa is Serine or Phosphoserine
HPGX

SEQ ID NO: 177 - protein, 4 aa, Artificial Sequence
  Synthetic peptide
  misc_feature (3)..(3): Xaa is Serine or Phosphoserine
PGXG

SEQ ID NO: 178 - protein, 4 aa, Artificial Sequence
  Synthetic peptide
  misc_feature (2)..(2): Xaa is Serine or Phosphoserine
GXGK

SEQ ID NO: 179 - protein, 4 aa, Artificial Sequence
  Synthetic peptide
  misc_feature (1)..(1): Xaa is Serine or Phosphoserine
XGKE

SEQ ID NO: 180 - protein, 4 aa, Artificial Sequence
  Synthetic peptide
  misc_feature (4)..(4): Xaa is Serine or Phosphoserine
ETNX

SEQ ID NO: 181 - protein, 4 aa, Artificial Sequence
  Synthetic peptide
  misc_feature (3)..(3): Xaa is Serine or Phosphoserine
TNXG

SEQ ID NO: 182 - protein, 4 aa, Artificial Sequence
  Synthetic peptide
  misc_feature (2)..(2): Xaa is Serine or Phosphoserine
NXGE

SEQ ID NO: 183 - protein, 4 aa, Artificial Sequence
  Synthetic peptide
  misc_feature (1)..(1): Xaa is Serine or Phosphoserine
XGEE

SEQ ID NO: 184 - protein, 4 aa, Artificial Sequence
  Synthetic peptide
  misc_feature (4)..(4): Xaa is Threonine or Phosphothreonine
FIEX

SEQ ID NO: 185 - protein, 4 aa, Artificial Sequence
  Synthetic peptide
  misc_feature (3)..(3): Xaa is Threonine or Phosphothreonine
IEXP

SEQ ID NO: 186 - protein, 4 aa, Artificial Sequence
  Synthetic peptide
  misc_feature (2)..(2): Xaa is Threonine or Phosphothreonine
EXPR

SEQ ID NO: 187 - protein, 4 aa, Artificial Sequence
  Synthetic peptide
  misc_feature (1)..(1): Xaa is Threonine or Phosphothreonine
XPRQ

SEQ ID NO: 188 - protein, 4 aa, Artificial Sequence
  Synthetic peptide
  misc_feature (4)..(4): Xaa is Serine or Phosphoserine
ELKX

SEQ ID NO: 189 - protein, 4 aa, Artificial Sequence
  Synthetic peptide
  misc_feature (3)..(3): Xaa is Serine or Phosphoserine
LKXV

SEQ ID NO: 190 - protein, 4 aa, Artificial Sequence
  Synthetic peptide
  misc_feature (2)..(2): Xaa is Serine or Phosphoserine
KXVE

SEQ ID NO: 191 - protein, 4 aa, Artificial Sequence
  Synthetic peptide
  misc_feature (1)..(1): Xaa is Serine or Phosphoserine
XVEN

SEQ ID NO: 192 - protein, 314 aa, Homo sapiens
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLENKDNIRLQDCSALCEEEEDEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 193 - protein, 398 aa, Homo sapiens
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSADTAGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 194 - protein, 393 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 195 - protein, 458 aa, Homo sapiens
MEATGTDEVDKLKTKFISAWNNMKYSWVLKTKTYFSRNSPVLLLGKCYHFKYEDEDKTLPAESGCTIEDHVIAGNVEEFRKDFISRIWLTYREEFPQIEGSALTTDCGWGCTLRTGQMLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVYNSDVIDKQSASMTSDNADDKAVIILVPVRLGGERTNTDYLEFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 196 - protein, 474 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 197 - protein, 275 aa, Homo sapiens
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 198 - protein, 703 aa, Homo sapiens
MAAATGDPGLSKLQFAPFSSALDVGFWHELTQKKLNEYRLDEAPKDIKGYYYNGDSAGLPARLTLEFSAFDMSAPTPARCCPAIGTLYNTNTLESFKTADKKLLLEQAANEIWESIKSGTALENPVLLNKFLLLTFADLKKYHFYYWFCYPALCLPESLPLIQGPVGLDQRFSLKQIEALECAYDNLCQTEGVTALPYFLIKYDENMVLVSLLKHYSDFFQGQRTKITIGVYDPCNLAQYPGWPLRNFLVLAAHRWSSSFQSVEVVCFRDRTMQGARDVAHSIIFEVKLPEMAFSPDCPKAVGWEKNQKGGMGPRMVNLSECMDPKRLAESSVDLNLKLMCWRLVPTLDLDKVVSVKCLLLGAGTLGCNVARTLMGWGVRHITFVDNAKISYSNPVRQPLYEFEDCLGGGKPKALAAADRLQKIFPGVNARGFNMSIPMPGHPVNFSSVTLEQARRDVEQLEQLIESHDVVFLLMDTRESRWLPAVIAASKRKLVINAALGFDTFVVMRHGLKKPKQQGAGDLCPNHPVASADLLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETI

SEQ ID NO: 199 - protein, 125 aa, Homo sapiens
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLSV

SEQ ID NO: 200 - protein, 125 aa, Homo sapiens; identical to SEQ ID NO: 199

SEQ ID NO: 201 - protein, 839 aa, Homo sapiens
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 202 - protein, 220 aa, Homo sapiens
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSYQVPVLYFRASFLDGRPLTLKDIWEGVHECYKMRLLQGPWDTITQQEHPILGQPFFVLHPCKTNEFMTPVLKNSQKINKNVNYITSWLSIVGPVVGLNLPLSYAKATSQDERNVP

SEQ ID NO: 203 - protein, 187 aa, Homo sapiens
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 204 - protein, 607 aa, Homo sapiens
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATKRLSQPAGGLLDSITNIFGRRSVSSFPVPQDNVDTHPGSGKEVRVPATALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 205 - protein, 450 aa, Homo sapiens
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKIVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 206 - protein, 125 aa, Bos taurus
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPICEVYESEKDEDGFLYMVYASQETFGMKLSV

SEQ ID NO: 207 - protein, 224 aa, Danio rerio
MMTGERKPASCFLDENTFRLCCRLFLQHSESIQDGWIWEQIKGSDEGFMKKTVLIPVKSSLLDKQHESIQAENTELPTDDFEADAEDETAGVDAVCESHAVLRYEYHVLYSCSYQIPVLYFRASALDGRSLSLEEVWSNVHPNYRQRLKQEPWDTLTQQEHPLLGQPFFMLHPCRTEEFMKPALELAHAQNRRVNYIVSWLSVVGPVVGLDVPLSFSTAVSAPD

SEQ ID NO: 208 - protein, 211 aa, Mus musculus
MEDEFFGEKSFQHYCAEFIRHSQQIGDGWEWRTAKECSDGYMCKTQFRIKNETLTPHASVLTCLPTEENLELPMDDSEVTRPAAVAEVIKHEYHVLYSCSYQVPVLYFRASFLDGRPLALEDIWEGVHECYKPRLLQGPWDTITQQEHPILGQPFFVLHPCKTNEFMTAVLKNSQKINRNVNYITSWLSLVGPVVGLNLPLSYAKATSQSE

SEQ ID NO: 209 - protein, 214 aa, Rattus norvegicus
MEDEFFGEESFQHCCAEFIRHSQQIGDGWEWRTAKECSDGYMCKTQFQIKKETPTPHRETPASVHTCLPTEENLELPVDDSEAVGPAAAAVIRQEYHVLYSCSYQVPVLYFRASFLDGRPLALEDIWEGVHECYKLRLLQGPWDTITQQEHPILGQPFFVLHPCKTNEFMTAVLKNSQKINRNVNYITSWLSIVGPVVGLNLPLSYAKATSQSE

SEQ ID NO: 210 - protein, 220 aa, Pan troglodytes
MEEDEFIGEKTFQRYCAEFIKHSQQIGDSWEWRPSKDCSDGYMCKIHFQIKNGSVMSHLGASTHGQTCLPMEEAFELPLDDCEVIETAAASEVIKYEYHVLYSCSHQVPVLYFRASFLDGRPLTLKDIWEGVHECYKMRLLQGPWDTITQQEHPILGQPFFVLHPCKTNEFMTPVLKNSQKINKNVNYITSWLSIVGPVVGLNLPLSYAKATSQDERNVH

SEQ ID NO: 211 - protein, 220 aa, Canis familiaris
MEEDEFFGEKTFQHFCAEFIKHSQQIGDGWEWRTSKDCSEGYMCKTHFQIKPGMPMSPPGTSAHIQTCLPMEEALELPLDDFEKTETTTGSEVIKYEYHVLYSCSYQVPVLYFRASFLDGRPLALKDIWEGTHECYKTRLLQEPWDTITQQEHPILGQPFFVLHPCKTNEFMTPVLKNSRKINRSVNYITSWLSVVGPVVGLNLPLSYARTASQDEGNVN

SEQ ID NO: 212 - protein, 232 aa, Bos taurus
MEENEFFGEKTFQHYCAEFIKHSQKIGDGWEWRASKDCSDGYMCKTHFQVKNGTAVSHQGTSDHVQTFLPVEEALDPPLDDLEVNETTTAAEVIKYEYHVLYSCSYQVPVLYFRASFLDGRPLALKDIWEGVHECYKMRLLQGPWDTITQQDKRVHRKNQGSTTKTAALVWSLTKRVKGLLRSNFPNYKHKVPTPPHAVALGLSLSASEPAPRVCSERLRRAPGSCKGFWDW

SEQ ID NO: 213 - protein, 187 aa, Homo sapiens; identical to SEQ ID NO: 203

SEQ ID NO: 214 - protein, 141 aa, Rattus norvegicus
MAEDPEAVLQLPAAPAAAAGESLLELSPETAIPEPPSSVAVSPGTEEPPGDTKKKIDILLKAVGDTPIMKTKKWAVERTRTVQALIDFIRKFLRLLASEQLFIYVNQSFAPSPDQEVGTLYECFGSDGKLVLHYCKSQAWG

SEQ ID NO: 215 - protein, 140 aa, Bos taurus
MAEEQESALQLPPSTAPEAEVPTEVSPETATPEPPSSAAVSPGTEEPVGDTKKKIDILLKAVGDTPIMKTKKWAVERTRTIQGLFDFIKKFLKLVASEQLFIYVNQSFAPSPDQEVGTLYECFGSDGKLVLHYCKSQAWG

SEQ ID NO: 216 - protein, 141 aa, Mus musculus
MSEDSEVVLQLPSAPVGAGGESLPELSPETATPEPPSSAAVSPGTEEPPGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 217 - protein, 76 aa, Pan troglodytes
MVEEPQSMLQLPPSSATGEEGLTEVSPETTTLEPPSSAAVSPGTEEPAGDTKKKIDILLKAVGDTPIMKTKKWAVE

SEQ ID NO: 218 - protein, 146 aa, Gallus gallus
MAEAEEQAPVSPQSEGRSGAGEEAPERTPESGASLGVGEPATSPAGSPGTEDPAGDAKKKIDVLLKAVGDTPIMKTKKWAVERTRTIQGLCDFIKKFLKLMASEQLFIYVNQSFAPSPDQEVGTLYECFGSDGKLVLHYCKSQAWG

SEQ ID NO: 219 - protein, 140 aa, Canis familiaris
MAEESESGLQLPPSTAAEGEGPTEVSPETATPEPPSSAAVSPGTEEPAGDTKKKIDVLLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 220 - protein, 330 aa, Danio rerio
MAGRRVECLWKRHVVEQLKQRDRVQRQAFEEIIHQYNRLLEKSDLQVVFSERLQTEKYEQQNRHDLSPCVDGGRSDSLQQEMSQMRIRHQEELTELHKKRGELAQSVIELNNQIQQKDKEIQSNEVKMQEYLQQISQLEGECRELRNCLADLERANQTLRDEYDALQITFSALEEKLRKTTEDNQELVTRWMAEKAQEANRLNAENEKDSRRRQAKLQKELADAAKEPLPIDPDDDIEVLTEDAGKATGETSPSRQLSRTPSKRLSQPPPPAGLLDSISNMFGRRRSVNSFSSSPENAEVPSACADVRVPSTALHIFDAHDGEVNAVICR

SEQ ID NO: 221 - protein, 607 aa, Mus musculus
MSSGLRAADFPRWKRHIAEELRRRDRLQRQAFEEIILQYTKLLEKSDLHSVLTQKLQAEKHDMPNRHEISPGHDGAWNDSQLQEMAQLRIKHQEELTELHKKRGELAQLVIDLNNQMQQKDKEIQMNEAKISEYLQTISDLETNCLDLRTKLQDLEVANQTLKDEYDALQITFTALEEKLRKTTEENQELVTRWMAEKAQEANRLNAENEKDSRRRQARLQKELAEAAKEPLPVEQDDDIEVIVDETSDHTEETSPVRAVSRAATKRLSQPAGGLLDSITNIFGRRSVSSIPVPQDIMDTHPASGKDVRVPTTASYVFDAHDGEVNAVQFSPGSRLLATGGMDRRVKLWEAFGDKCEFKGSLSGSNAGITSIEFDSAGAYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESVVREMELLGKITALDLNPERTELLSCSRDDLLKVIDLRTNAVKQTFSAPGFKCGSDWTRVVFSPDGSYVAAGSAEGSLYVWSVLTGKVEKVLSKQHSSSINAVAWAPSGLHVVSVDKGSRAVLWAQP

SEQ ID NO: 222 - protein, 588 aa, Rattus norvegicus
MSSGLRAADFPRWKRHIAEELRRRDRLQRQAFEEIILQYTKLLEKSDLHSVLTQKLQAEKHDVPNRHEISPGHDGAWNDSQLQEMAQLKMKHQEELTELHKKRGELAQLVIDLNNQMQQKDKEIQTNEAKIAECLQTISDLEADCLDLRTKLQDLEVANQTLKDEYDALQITFTALEEKLRKTTEENQELVTRWMAEKAQEANRLNAENEKDSRRRQARLQKELAEAAKEPLPVEQDDDIEVIVDETSDHTEETSPVRAISRAATRRSVSSIPVPQDVVDTHPASGKDVRVPTTASYVFDAHDGEVNAVQFSPGSRLLATGGMDRRVKLWEAFGDKCEFKGSLSGSNAGITSIEFDSAGAYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESVVREMELLGKITALDLNPERTELLSCSRDDLLKIIDLRTNAIKQSFSAPGFKCGSDWTRVVFSPDGSYVAAGSADGSLYVWSVLTGKVEKVLSKQHSSSINAVAWAPSGLHVVSVDKGSRAVLWAQP

SEQ ID NO: 223 - protein, 607 aa, Gallus gallus
MASGLHAAGFPPWKRHIAAELRRRDRLQRQAFEEIVAQYNKLLEKSDLHAVLADKLQAEKYDMQSRHEISPGHDGTWNDAQLQELAQLKIKHQEELTELHKKRGELAQSVIDLNNQMQQKDKEMQMNEAKIAEYLQKISELETECQELRSKLQDLERANQTLKDEYDALQITFNALEEKLRKTTEDNQELVSRWMAEKAQEANRLNAENEKDSRRRQARLQKELAEAAKEPLPVEPDDDIEVLADETSDTAEETSPVRAVSRTPSKRLSQPAGGLLDSITNIFGRRSLSSFPPPQDNAEPHPGASKEVRVPTTAICVFDAHDGEVNAVQFSPGSRLLATGGMDRRVKLWEVLGDRCEPKGSLSGSNAGITSIEFDSAGSYLLAASNDFASRIWTVDDNRLRHTLTGHSGKVLSAKFLLDNARIVSGSHDRTLKLWDLRSKVCIKTVFAGSSCNDIVCTEQCVMSGHFDKKIRFWDIRTESIVKELELLGRITALDLNSERTELLTCSRDDLLKIIDLRVGAVKQTFSAQGFKCGSDWTRVVFSPDGNYVAAGSADGALYVWNVLTGKLERTLAKHHSSPINAVAWSPAGAHVVSVDKGNKAVLWSEF

SEQ ID NO: 224 - protein, 623 aa, Canis familiaris
MSSGLRAADFPRWKRHISEELRRRDRLQRQAFEEIILQYNKLLEKSDLHSVLAHKLQAEKHDIPNRHEISPGHDGAWNDGQLQEMAQLRIRHQEELTELHKKRGELAQLVIDLNNQMQQKDREMQMNEAKIAECLQTISDLETECQELRSKLQDLERANQTLKDEYDALQITFTALEEKLRKTTEENQELVTRWMAEKAQEANRLNAENEKDSRRRQARLQKELAEAAKEPLPVEQDDDIEVIVDETSDHAEETSPVRAISRAATKRLSQPAGGLLDSITNIFGLSESPLLGHHSSDAARRRSVSSFPVPQDNVDTHPGSSKEVRVPTTAMCIFDAHDGEVNAVQFSPGSRLLATGGMDRRVKLWEVFGDKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKIIDLRINAVRQTFSAPGFKCGSDWTRVVFSPDGGYVAAGSAEGSLYIWSVLSGKVEKVLSKQHGSSINAVAWSPSGSHVVSVDKGSKAVLWSEY

SEQ ID NO: 225 - protein, 607 aa, Bos taurus
MSSGLRAAVFPRWKRHISEELRRRDRLQRQAFEEIILQYNKLLEKSDLHSVLAHKLQAEKHDVPNRHEISPGHDGSWNDSQLQEMAQLRIKHQEELTELHKKRGELAQLVIDLNNQMQQKDKEMQMNEAKIAEYLQTISDLETECQELRTKLQDLERANQTLKDEYDALQITFTALEEKLRKTSEENQELVTRWMAEKAQEANRLNAENEKDSRRRQARLQKELAEAAKEPLPVEQDDDIEVLVDETSEHPEETSPVRAISRAATKRLSQPAGGLLDSITNIFGRRSVSSFPVPQDNVDPHPGAGKEVRVPTTAMSVFDAHDGEVNAVQFSPGSRLLATGGMDRRVKLWEVFGDKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKIIDLRINAVRQTFSAPGFKCGSDWTRAVFSPDGSYVAAGAAEGSLYIWNVLSGKVEKVLSKHHSSSINAVAWSPAGSHVVTVDKGSKAVLWSEY

SEQ ID NO: 226 - protein, 314 aa, Homo sapiens; identical to SEQ ID NO: 192

SEQ ID NO: 227 - protein, 314 aa, Bos taurus
MQNVINTVKGKALEVAEYLTPVLKESKFKETGVITPEEFVAAGDHLVHHCPTWQWATGEELKVKAYLPSGKQFLVTKNVPCYKRCKQMEYSDELEAIIEEDDGDGGWVDTYHNTGIAGITEAVKEITLESKDSIKLQDCSALCEEEEEEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 228 - protein, 314 aa, Mus musculus
MQNVINTVKGKALEVAEYLTPVLKESKFKETGVITPEEFVAAGDHLVHHCPTWQWATGEELKVKAYLPTDKQFLVTKNVPCYKRCKQMEYSDELEAIIEEDDGDGGWVDTYHNTGITGITEAVKEITLESKDSIKLQDCSALCDEEDEEDEGEAADMEEYEESGLLETDEATLDTRKIVEACKAKADAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 229 - protein, 314 aa, Rattus norvegicus
MQNVINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNTGITGITEAVKEITLESKDSIKLQDCSVLCDEEEEEEEGEAADMEEYEESGLLETDEATLDTRRIVEACKAKADAGGEDAILQTRTYDLYITYDKYYQTPRLWLFGYDEQRQPLTVEHMYEDISQDHVKKTVTIENHPHLPPPLMCSVHPCRHAEVMKKIIETVAEGGGELGVHMYLLIFLKFVQAVIPTIEYDYTRHFTM

SEQ ID NO: 230 - protein, 330 aa, Drosophila melanogaster
MQSVLNTVKGTALNVAEYLTPVLKESKFRETGVLTPEEFVAAGDHLVHHCPTWQWAAGDETKTKPYLPKDKQFLITRNVPCYRRCKQMEYVGEETLVEEESGDGGWVETHQLNDDGTTQLEDKICELTMEETKEEMHTPDSDKSAPGAGGQAEDEDDDEAIDMDDFEESGMLELVDPAVATTTRKPEPEAKASPVAAASGDAEASGDSVLHTRTYDLHISYDKYYQTPRLWVVGYDEQRKPLTVEQMYEDVSQDHAKKTVTMESHPHLPGPNMASVHPCRHADIMKKIIQTVEEGGGQLGVHLYLIIFLKFVQTVIPTIEYDFTQNFNMS

SEQ ID NO: 231 - protein, 317 aa, Danio rerio
MQNVINSVKGTALGVAEFLTPVLKESKFKETGVITPEEFVAAGDHLVHHCPTWKWASGEEAKVKPYLPNDKQFLLTRNVPCYKRCKQMEYSDELEAIIEEDDGDGGWVDTFHNSGVTGVTEAVREISLDNKDNMNMNVKTGACGNSGDDDDDEEGEAADMEEYEESGLLETDDATLDTSKMADLSKTKAEAGGEDAILQTRTYDLYITYDKYYQTPRLWLFGYDEDRQPLTVDQMYEDISQDHVKKTVTIENHPNLPPPAMCSVHPCRHAEVMKKIIETVAEGGGELGVHMYLLIFLKFVQAVIPTIEYDYTRHFTM

SEQ ID NO: 232 - protein, 314 aa, Pan troglodytes; identical to SEQ ID NO: 192

SEQ ID NO: 233 - protein, 334 aa, Anopheles gambiae str. PEST
MQNVLNSVKGTALGVAEYLTPVLKESKFRETGVLTPEEFIAAGDHLTHHCPTWSWAVGDESKIKPYLPKDKQFLITRNVPCRRRCKQIEFVGEENLVEENDPDGGWVETHHYNPDEAGSSGLEDKVCEMKLDSSRIEDEPAADMDDPRNLEDGDGDGGQDDDEDGAAIDMDEFEESGLLEMVDPSNALLPAPNEKPKPTVAASETEGDSVVRTRTYDLHITYDKYYQTPRLWVIGYDENRKLLSVEQMYDDVSQDHAKKTVTMETHPHLPGPNMASVHPCKHADIMKKIIQTVEEGGGELGVHMYLIIFLKFVQTVIPTIEYDFTQNFNITNHK

SEQ ID NO: 234 - protein, 313 aa, Gallus gallus
MQNVINTVKGKALEVAEYLTPVLKESKFKETGVITPEEFVAAGDHLVHHCPTWQWASGEELKVKAYLPTDKQFLVTKNVPCYKRCKQMEYSDEQEAIIEEDDGDGGWVDTFHNAGIVGATEAVKEITLDSKDNIKIPERSASCEDDDDEDEGEAADMEEYEESGLLETDDATLDTRQIVEVKAKVDVGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 235 - protein, 312 aa, Canis familiaris
MCINTVKGKALEVAEYLTPVLKESKFKETGVITPEEFVAAGDHLVHHCPTWQWATGEELKVKAYLPTGKQFLVTKNVPCYKRCKQMEYSDELEAIIEEDDGDGGWVDTYHNAGVTGITEAVKEITLESKDSIKLQDCSAVCEEEEEEDEGEAADMEEYEESGLLETDEATLDTRKIVEACKAKTDAGGEDAILQTRTYDLYITYDKYYQTPRLWLFGYDEQRQPLTVEHMYEDISQDHVKKTVTIENHPHLPPPPMCSVHPCRHAEVMKKIIETVAEGGGELGVHMYLLIFLKFVQAVIPTIEYDYTRHFTM

SEQ ID NO: 236 - protein, 398 aa, Bos taurus
MESVLSKYENQITIFADYLEEFPDTDELVWILGKQHLLKTEKSKLLSDISARLWFTYRRKFSPIGGTGPSSDAGWGCMLRCGQMMLAQALICRHLGRDWNWEKQKEQPKEYQRILQCFLDRKDCCYSIHQMAQMGVGEGKSIGEWFGPNTVAQVLKKLALFDEWNSLAVYVSMDNTVVIEDIKKMCRTLSLSADTPAERPLESLTASNQSKGPSACCTAWKPLLLIVPLRLGINQINPVYVDAFKECFKMPQSLGALGGKPNNAYYFIGFLGDELIFLDPHTTQTFVDTEENGTADDQTFHCLQPPQRMNILNLDPSVALGFFCKEEKDFDSWCSLVQKEILKENLRMFELVQKHPSHWPPFVPPAKPEVTTTGAEFIDSTEQLEEFDLEEDFEILSI

SEQ ID NO: 237 - protein, 375 aa, Danio rerio
MEAVLAKYENQINVFLEDLPDTDEPVWILGACYNVKTKKSELLSDVRSRLWFTYRKKFSPIGGTGPSSDAGWGCMLRCGQMILAQALICSHLGRDWRWDPEKHQPKEYQRILDCFLDKKDSCYSIHQMAQMGVGEGKSVGEWYGPNTVAQVLKKLALFDDWNSLSVYVSMDNTVVIEDIKKLCVRADLQLQSQQPLDWRPLLLVIPLRMGINSINPVYIQALKECFKMPQSCGVLGGKPNLAYYFIGFIDDELIYLDPHTTQQAVDTESGSAVDDQSFHCQRTPHRMKITSLDPSVALGFFCKSEEDFDSWCDLVQQELLKKRNLRMFELVEKHPSHWPPFVPPTKPEVQTTGAEFIESPDKLSESEEEFEILNA

SEQ ID NO: 238 - protein, 493 aa, Caenorhabditis elegans
MTEEILKQGVGIVETSLTFEPPFCESFERISIDNFPIFALGKEISKEDGIEAMKKYVTSRFWFTYRRDFSPIGGTGPSTDQGWGCMLRCAQMLLGEVLLRRHIGRHFEWDIEKTSEIYEKILQMFFDEKDALYSIHQIAQMGVTEGKEVSKWFGPNTAAQVMKKLTIFDDWSNIAVHVALDNILVKEDAITMATSYPSEDAVKLIMGKKGLQTTKRKNRKNLDFTVKYLKQIKFFKFFNLFQIFYENGLVDKNRLSLSPGNIIPEWRPLLLMIPLRLGLTTINPCYLSAIQEFFKIPQCVGIIGGRPNHALYFVGMSGSKLFYLDPHYCRPKTESTAKMYAEKDSTATTDDVGFSHLEELVPLPSQTADVYTKMDDSTYHCQMMLWIEYENVDPSLALAMFCETRDEFENLCETLQKTTLPASQPPMFEFLQRRPKYLPKFEPYTGVSMKIEMKEFDDIGAANVKIDDDFEVLDVHTEEEDADEDNDDDVANA

SEQ ID NO: 239 - protein, 396 aa, Mus musculus
MESVMSKYENQILIFPDYLEEFPDTDELVWILGKQHPLKTEKSKLLSDISARLWFTYRRKFSPIGGTGPSSDAGWGCMLRCGQMMLAQALICRHLGRDWNWERQKEQPKEYQRILQCFLDRKDCCYSIHQMAQMGVGEGKSIGEWFGPNTVAQVIKKLALFDEWNSLAVYVSMDNTVVIEDIKKMCCVLPVGAADPAGDFLTASNQSRDTSVPCSAWKPLLLIVPLRLGINQINPVYVEAFKECFKMPQSLGALGGKPNNAYYFIGFLGDELIFLDPHTTQTFVDIEESGLVDDQTFHCLQSPQRMSILNLDPSVALGFFCKEEKDFDNWCSLVQKEILKENLRMFELVQKHPSHWPPFVPPAKPEVTTTGAEFIESTEQLEDFELEEDFEILSVG

SEQ ID NO: 240 - protein, 398 aa, Pan troglodytes
MESVLSKYEDQITIFTDYLEEYPDTDELVWILGKQHLLKTEKSKLLSDISARLWFTYRRKFSPIGGTGPSSDAGWGCMLRCGQMMLAQALICRHLGRDWSWEKQKEQPKEYQRILQCFLDRKDCCYSIHQMAQMGVGEGKSIGEWFGPNTVAQVLKKLALFDEWNSLAVYVSMDNTVVIEDIKKMCRVLPLSIDTPGDRPPDSLTASNQSKGTSAYCSAWKPLLLIVPLRLGINQINPVYVDAFKECFKMPQSLGALGGKPNNAYYFIGFLGDELIFLDPHTTQTFVDTEENGTVNDQTFHCLQSPQRMNILNLDPSVALGFFCKEEKDFDNWCSLVQKEILKENLRMFELVQKHPSHWPPFVPPAKPEVTTTGAEFIDSTEQLEEFDLEEDFEILSV

SEQ ID NO: 241 - protein, 460 aa, Canis familiaris
MTANQKSGRLWELQFERSSGWRGAFTVLTDSAPSSAELQVPGSLAAAVVKCRVELAQDDSWRMESVLSKYENQITIFADYLEEFPDSDELVWILGKQHLLKTEKSKLLSDIRARLWFTYRRKFSPIGGTGPSSDAGWGCMLRCGQMMLAQALICRHLGRDWSWEKQKEQPREYQRILQCFLDRKDCCYSIHQMAQMGVGEGKSIGEWFGPNTVAQVLKKLALFDEWNSLAIYVSMDNTVVIEDIKKMCCVLPLSADTIGESPLNTLNASNQSKSAPASCPAWKPLLLIVPLRLGINQINPVYVDAFKECFKMPQSLGALGGKPNNAYYFIGFLGDELIFLDPHTTQTFVDTEENGTVDDQTFHCLQSPQRMNILNLDPSVALGFFCKEEKDFDSWCSLVQKEILKENLRMFELVQKHPSHWPPFVPPAKPEVTTTGAEFIDSTEQLEDFDLEEDFEILSV

SEQ ID NO: 242 - protein, 393 aa, Bos taurus
MDAATLTYDTLRFAEFEDFPETSEPVWILGRKYSVLTEKDEILADVASRLWFTYRKNFPAIGGTGPTSDTGWGCMLRCGQMIFAQALVCRHLGRDWRWTQRKRQPDSYCSVLQAFLDRKDSCYSIHQIAQMGVGEGKSIGQWYGPNTVAQVLKKLAVFDTWSALAVHVAMDNTVVMADIRRLCRSSLPCAGAEAFPADSERHCNGFPAGAEGGGRAAPWRPLVLLIPLRLGLADVNAAYAGTLKHCFRMPQSLGVIGGKPNSAHYFIGYVGEELIYLDPHTTQPAVAAADRCPVPDESFHCQHPPGRMSIAELDPSIAVGFFCETEDDFNDWCQQVSKLSLLGGALPMFELVEQQPSHLACPDVLNLSLDSSDAERLERFFDSEDEDFEILSL

SEQ ID NO: 243 - protein, 393 aa, Mus musculus
MDAATLTYDTLRFAEFEDFPETSEPVWILGRKYSIFTEKDEILSDVASRLWFTYRRNFPAIGGTGPTSDTGWGCMLRCGQMIFAQALVCRHLGRDWRWTQRKRQPDSYFNVLNAFLDRKDSYYSIHQIAQMGVGEGKSIGQWYGPNTVAQVLKKLAVFDTWSSLAVHIAMDNTVVMEEIRRLCRANLPCVGAAALPTDSERHCNGFPAGAEVTNRPSAWRPLVLLIPLRLGLTDINEAYVETLKHCFMMPQSLGVIGGKPNSAHYFIGYVGEELIYLDPHTTQPAVELTDSCFIPDESFHCQHPPSRMGIGELDPSIAVGFFCKTEEDFNDWCQQVKKLSQLGGALPMFELVEQQPSHLACQDVLNLSLDSSDVERLERFFDSEDEDFEILSL

SEQ ID NO: 244 - protein, 393 aa, Gallus gallus
MDAATLTYDTLRFEYEDFPETKEPVWILGRKYSVFTEKEEILLDVTSRLWFTYRKNFPAIGGTGPTSDTGWGCMLRCGQMIFAQALVCRHLGRDWRWIKGKRQTDNYFSVLNAFIDKKDSYYSIHQIAQMGVGEGKSIGQWYGPNTVAQVLKKLATFDTWSSLAVHIAMDNTVVMEEIRRLCQSNFSCAGAAACPAVEADVLYNGYPEEAGVRDKLSLWKPLVLLIPLRLGLTEINEAYIETLKHCFMMPQSLGVIGGKPNSAHYFIGYVGEELIYLDPHTTQPAVEPSDSGCLPDESFHCQHPPCRMSIAELDPSIAVGFFCHTEEDFNDWCHQIKKLSLVRGALPMFELVERQPSHFSNPDVLNLTPDSSDADRLERFFDSEDEDFEILSL

SEQ ID NO: 245 - protein, 306 aa, Pan troglodytes
MLRCGQKIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRLSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFSDWCQQVKKLSLLGGALPMFELVEQQPSHLACPDVLNLSLGESCQVQILLM

SEQ ID NO: 246 - protein, 394 aa, Canis familiaris
MLTDATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFNVLNAFIDRKDSYYSIHQIAQMGVGEGKSIGQWYGPNTVAQVLKKLAVFDTWSALAVHIAMDNTVVMEDIRRLCRGSLPCAGAAALPADSSRHCNGFPAGAEVTNRLAPWRPLVLLIPLRLGLTDINEAYVETLKRCFMMPQSLGVIGGKPNSAHYFIGYVGEELIYLDPHTTQPAVEFTDSCFIPDESFHCQHPPSRMSIGELDPSIAVGFFCKTEGDFDDWCQQVRQLSLLGGALPMFELVEQQPSHLACPDVLNLSLDSSDVERLERFFDSEDEDFEILSL

SEQ ID NO: 247 - protein, 458 aa, Mus musculus
MEASGTDEVDKLKTKFISAWNNMKYSWVLKTKTYFSRNSPVLLLGKCYHFKYEDESKMLPARSGCAIEDHVIAGNVEEFRKDFISRLWLTYREEFPQIEASALTTDCGWGCTLRTGQMLLAQGLILHFLGRAWTWPDALHIENADSDSWTSNTVKKFTASFEASLSGDRELRTPAVSLKETSGKCPDDHAVRNEAYHRKIISWFGDSPVAVFGLHRLIEFGKKSGKKAGDWYGPAVVAHILRKAVEEARHPDLQGLTIYVAQDCTVYNSDVIDKQTDSVTAGDARDKAVIILVPVRLGGERTNTDYLEFVKGVLSLEYCVGIIGGKPKQSYYFAGFQDDSLIYMDPHYCQSFVDVSIKDFPLETFHCPSPKKMSFRKMDPSCTIGFYCRNVQDFERASEEITKMLKISSKEKYPLFTFVNGHSKDFDFTSTAASEEDLFSEDERKNFKRFSTEEFVLL

SEQ ID NO: 248 - protein, 458 aa, Pan troglodytes; identical to SEQ ID NO: 195

SEQ ID NO: 249 - protein, 458 aa, Bos taurus
MEATGTDDVDKLKTKFISAWNNMKYSWVLKTKTYFSRNSPVLLLGKCYHFKYEDENELLPARSGCTIEDHVIAGNVEEFRKDFISRIWLTYREEFPQIEGSALTTDCGWGCTLRTGQMLLAQGLILHFLGRAWTWPDALNIENSDSESWTSNTVKKFTASFEASLSGERELKTPTISLKEKMERYSDDREMQNEIYHRKIISWFGDSPLALFGLHQLIECGKKSGKKAGDWYGPAVVAHILRKAVEEARHPDLKGITIYVAQDCTVYSSDVIDKQCTSMASDNTNDKAVIILVPVRLGGERTNADYLDFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKISSKEKYPLFTFVNGHSRDYDFTSTTTNEEDLFSEDEKKRIKRFSTEEFVLL

SEQ ID NO: 250 - protein, 449 aa, Rattus norvegicus
MHLNWKCNRPGLLQIPGWVLKTKTYFSRNSPVLLLGKCYHFKYEDESKVLPARSGCAIEDHVIAGNVEEFRKDFISRIWLTYREEFPQIEASALTTDCGWGCTLRTGQMLLAQGLILHFLGRAWTWPDALHIESSDSDSWTSNTIHKFTASFEASLSGERELRTPAVSLKETSGKHPDDHAVQSEIYHRQIISWFGDSPVAVFGLHRLIEFGKKSGKKAGDWYGPAVVAHILRKAVEEARHPDLQGLTIYVAQDCTVYNSDVIDKQTDSVTAGDARDKAVIILVPVRLGGERTNIDYLEFVKGVLSLEYCVGIIGGKPKQSYYFAGFQDDSLIYMDPHYCQSFVDVSIKDFPLETFHCPSPKKMSFRKMDPSCTIGFYCRNVQDFERASEEITKMLKISSKEKYPLFTFVNGHSRDFDFTSTAASEEDLFLEDEKKNFKRFSTEEFVLL

SEQ ID NO: 251 - protein, 459 aa, Gallus gallus
MEATGTDEVEKIKSKFMSAWNNMKYSWVLKTKTYFSRNSPVFLLGKCYHFKSDESGELSTEGSNFDKINTEISGNVEEFRKDFISRIWLTYREEFPQIKGSALTTDCGWGCTLRTGQMLLAQGLMLHFLGRAWVWPDALDIENSDSESWTAHTVKKLTASLEASLTAEREPKILSHHQERTLRRDCGDSEMRNEVYHRKIISWFGDSPLAAFGLHQLIEYGKKSGKIAGDWYGPAVVAHILRKAVEEARDPELQGVTVYVAQDCTVYSSDVIDRQCSFMDSGETDTKAVIILVPVRLGGERTNMDYLEFVKGILSLEYCVGIIGGKPKQSYYFAGFQDDSLIYMDPHYCQSFVDVSIKDFPLESFHCPSPKKMSFKKMDPSCTIGFYCRTVQDFEKASEEITKMLKSSSKEKYPLFTFVKGHSRDYDFASSPLHEENDLFSEDEKKRLKRFSTEEFVLL

SEQ ID NO: 252 - protein, 458 aa, Canis familiaris
MEATGTDEVDKLKTKFISAWNNMKYSWVLKTKTYFSRNSPVLLLGKCYHFKFEDENKLLPARSGCTIEDHVIAGNVEEFRKDFISRIWLTYREEFPQIEGSAFTTDCGWGCTLRTGQMLLAQGLILHFLGRAWTWPDALNIENSDSDSWTSNTVKKFTASFEASLSGESELKTPTVSQKETIRRHSDDHEMRNEIYHRKIISWFGDSPLALFGLHQLIKYGKKSGKKAGDWYGPAVVAHILRKAVEEARHPDLQGITIYVAQDCTVYSSDVIDKQCTSMASDNTDDKAVIILIPVRLGGERTNTDYLDFVKGILSLEYCVGIIGGKPKQSYYFAGFQDDSLIYMDPHYCQSFVDVSIKDFPLETFHCPSPKKMSFRKMDPSCTIGFYCRNVQDFKRASEEITKMLKISSKEKYPLFTFVNGHSRDYDFTSTTTNEEDLFSEDEKKRLKRFSTEEFVLL

SEQ ID NO: 253 - protein, 668 aa, Drosophila melanogaster
MNYDGLLSKLTDEKLMLFEAAGEGTIVEGSRICGQDADPLSLPLVEDGAIEEEQAAPIQTIHRTVFAVPRVPSPSPVSTSGANLNLKTENAATATPQRKISTSSRFMNAFSQLYGGGNSGPSCGHVEQHNEEPGDLSANRTPTKGMESKLVAMWHNVKYGWSGKMRQTSFSKEQPVWLLGRCYHRRFTPPVSMESSITELPSGADTTPDNATSAFDSIQATSTSTSLYPALNPQQIDEIVVPQELGMDAVENQVGEQPWEEGIEGFRRDFYSRIWMTYRREFPIMNGSNYTSDCGWGCMLRSGQMLFAQGLICHFLGRSWRYDSESQLHSTYEDNMHKKIVKWFGDSSSKSSPFSIHALVRLGEHLGKKPGDWYGPASVSYLLKHALEHAAQENADFDNISVYVAKDCTIYLQDIEDQCSIPEPAPKPHVPWQQAKRPQAETTKTEQQQHWKSLIVLIPLRLGSDKLNPVYAHCLKLLLSTEHCLGILGGKPKHSLYFVGFQEDRLIHLDPHYCQEMVDVNQENFSLHSFHCKSPRKLKASKMDPSCCIGFYCATKSDFDNFMESVQLYLHPMRCASGATVDKAAGSHHTTPQSSHQTEQTEMNYPLFSFSRGRCMDHERDEMSDSLYKPLIKQVASLAQELGAQLAPPQHGDEHDQDDSESEEFVLL

SEQ ID NO: 254 - protein, 474 aa, Mus musculus [sequence omitted]

SEQ ID NO: 255 - protein, 411 aa, Pan troglodytes
MQVLHLAGRCPYVSPGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSEVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 256 - protein, 473 aa, Canis familiaris
MNSVSPAAAQYRSGSPEDARRPEGRRPRGPRVPDPNGPRPSGASGPALGSPAAAPGEPDEVDKFKAKFLTAWNNVKYGWAVKSRTSFSKISSVHLCGRRYRFEGEGDIQRFQRDFVSRLWLTYRRDFPPLAGGCLTSDCGWGCMLRSGQMMLAQGLLLHFLPRDWTWAEGPGLGPSEPAGLASPNRYRGPARWMPPRWAQGTPELEQERRHRQIVSWFADHPQAPFGLHRLVELGQSSGKKAGDWYGPSLVAHILRKAVESCSEITRLVVYVSQDCTVYKADVARLVARPDPTAEWKSVVILVPVRLGGETLNPVYVPCVKELLRSELCLGIMGGKPRHSLYFIGYQDDFLLYLDPHYCQPTVDVSQADFPLESFHCTSPRKMAFAKMDPSCTVGFYAGDQKEFETLCSELTRVLSSSSATERYPMFTLAEGHAQDHSLDDLCSQLSQPTLRLPRTGRLLKAKRPSSEDFVFL

SEQ ID NO: 257 - protein, 567 aa, Anopheles gambiae str. PEST
AAVRGSDGTKTPGRKISLPPHAHRHESVSASCSPMRGGPAANHSTATGGPGEEFKGKVESKLLTMWNNMKFGWSYKMKTNFSKEQPLWLLGRCYHQKITPVTSMESSVELGTSGPDGQLMVLQNVYFAEPSNSPPEETGTDAIEDSSPEAIVEEEGIDAFRRDFISRIWMTYRREFQTMDDSNYTSDCGWGCMIRSGQMLLAQGLVAHFLGRSWRWDVSMFTAYEESIHRKVIRWFGDTSSKTSPFSIHTLVALGKESGKKPGDWYGPGAVAHLLRQAVRLAAQEITDLDGINVYVAQDCAVYIQDILDECTVPATPAGAPWQRKGAPGGTNSSSSTAHTERSGATSCAEGDEDVQSAHWKSLILLVPLRLGTDKLNPIYNECLKAMLSLDYCIGIIGGRPKHSLYFVGYQEDKLIHLDPHYCQDMVDVNQDNFPVASFHCKSPRKMKLSKMDPSCCIGFYCETKKDFYKFIDSVKPFLIPVQPGNQDAGYANPSSGSSTGSVSYPMFVFCRGKSSEQRADLPGQQHQYPHPTAYRSPPTAIPQQAAGGNDDDDEEDEDEAIEFVIL

SEQ ID NO: 258 - protein, 472 aa, Bos taurus
MNSVSPAAAQYRSGSPEDARRPEGRRPRGPRTPDPHGLGPSGASGPALASPGTGPGEPDEVDKFKAKFLTAWNNVKYGWAVKSRTSFSKISSVHLCGRRYRFEGEGDIQRFQRDFVSRLWLTYRRDFPPLAGGSLTSDCGWGCMLRSGQMMLAQGLLLHFLPRDWTWCQGAGLGPSEPPGLGSPSRRRGPARWLPPRWAQAPELEQERRHRQIVSWFADHPRAPFGLHRLVELGQGSGKKAGDWYGPSLVAHILRKAVESCSEVTRLVVYVSQDCTVYKADVARLVARPDPTAEWKSVVILVPVRLGGETLNPVYVPCVKELLRSELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLVEGHAQDHSLDDLCSPPSQQTLRLPRSGRLLKAKRPSSEDFVFL

SEQ ID NO: 259 - protein, 275 aa, Homo sapiens; identical to SEQ ID NO: 197

SEQ ID NO: 260 - protein, 275 aa, Gallus gallus
MTDDKDVLRDVWFGRIPTCFTLYQDEITEREAEPYYLLLPRISYLTLVTDKVKKHFQKVMRQEEVNEIWFEYEGTPLKWHYPIGLLFDLHASNTALPWSITVHFKNFPEKDLLHCHSKDVIEAHFMACIKEADALKHKSQVINEMQKKDHKQLWMGLQNDKFEQFWAINRKLMEYPPEDSGFRYIPFRIYQATTERPFIQKLFRPIASGGQLHTLGDLLKDVCPSAITPEDGEKTTQVMIHGIEPMLETPLQWLSEHMSYPDNFLHISIIPRPTD

SEQ ID NO: 261 - protein, 275 aa, Bos taurus
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDVIEAHFMSCVKEADALKHKSQVINEMQKKDHKQLWMGLQNDRFDQFWAINRKLMEYPAEENGFRYIPFRIYQTTTERPFIQKLFRPVSTDGQLHTLGDLLKEVCPSAVAPEDGEKKNQVMIHGIEPMLETPLQWLSEHLSYPDNFLHISIIPQPTD

SEQ ID NO: 262 - protein, 275 aa, Mus musculus
MTDDKDVLRDVWFGRIPTCFTLYQDEITEREAEPYYLLLPRVSYLTLVTDKVKKHFQKVMRQEDVSEIWFEYEGTPLKWHYPIGLLFDLLASSSALPWNITVHFKSFPEKDLLHCPSKDAVEAHFMSCMKEADALKHKSQVINEMQKKDHKQLWMGLQNDRFDQFWAINRKLMEYPPEENGFRYIPFRIYQTTTERPFIQKLFRPVAADGQLHTLGDLLREVCPSAVAPEDGEKRSQVMIHGIEPMLETPLQWLSEHLSYPDNFLHISIVPQPTD

SEQ ID NO: 263 - protein, 275 aa, Danio rerio
MIMADDKDVLRDVWFGRIPACFTLSPDETTEREAEPYYLLLPRVSYLTLVTDKVKKHFLKVMKAEDVEEMWFEHEGTPLKWHYPIGVLFDLHASNSALPWNVTVHFKNFPEQDLLHCSTNSVIEAHFMSCIKEADALKHKGQVINDMQKKDHKQLWMGLQNDKFDQFWAMNRKLMEYPTEEGGFRYIPFRIYQTMSDRPFIQTLFRPVSSEGQALTLGDLLKELFPAAIEDEPKKFQVMIHGIEPLLETPIQWLSEHLSHPDNFLHISIIPAPSD

SEQ ID NO: 264 - protein, 275 aa, Pan troglodytes; identical to SEQ ID NO: 197

SEQ ID NO: 265 - protein, 275 aa, Canis familiaris
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCVKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIAPEDGEKKNQVMIHGIEPMLETPLQWLSEHLSYPDNFLHISIIPQPTD

SEQ ID NO: 266 - protein, 698 aa, Rattus norvegicus
MGDPGLSKLQFAPFNSALDVGFWHELTQKKLNEYRLDEAPKDIKGYYYNGDSAGLPTRLTLEFSAFDMSAPTPARCCPAMGTLHNTNTLEAFKTADKKLLLEQSANEIWEAIKSGAALENPMLLNKFLLLTFADLKKYHFYYWFCCPALCLPESIPLIRGPVGLDQRLSPKQIQALEHAYDDLCRTEGVTALPYFLFKYDDDTVLVSLLKHYSDFFQGQRTKLTVGVYDPCNLTQHPGWPLRNFLVLAAHRWSGSFQSVEVLCFRDRTMQGARDVTHSIIFEVKLPEMAFSPDCPKAVGWEKNQKGGMGPRMVNLSGCMDPKRLAESSVDLNLKLMCWRLVPTLDLDKVVSVKCLLLGAGTLGCNVARTLMGWGVRHVTFVDNAKISYSNPVRQPLYEFEDCLGGGKPKALAAAERLQKIFPGVNASGFNMSIPMPGHPVNFSDVTMEQARRDVEQLEELIDSHDVIFLLMDTRESRWLPTVIAASKRKLVINAALGFDTFVVMRHGLKKPKQQGAGDLCPSHLVAPADLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSSKVLDQYEQEGFTFLAKVFNSSHSFLEDLTGLTLLHQETQAAEIWDMSDEETV

SEQ ID NO: 267 - protein, 703 aa, Homo sapiens; identical to SEQ ID NO: 198

SEQ ID NO: 268 - protein, 709 aa, Gallus gallus
MAAVSNESQNPVDPGSSKLQFAPFSSALNVGFWHELTQKKLNEYRLDETPKVIKGYYYNGDPSGFPARLTLEYSAFDINASIPARCCPAFGTLYNTNTFETFKSCDKKSLLEKEANEIWESIKSGAALENPMLLNRFLLLTFADLKKYHFYYWFCYPALCFPDGIHVIQKPVCLGDRFSLNQIQALQKAYDELCQTEGVTAFPYFLIKYHDNSVVVSPLKKWDGFFQDQGGKVTVGVYDPCNLSHYPGWPLRNFLILASHKWGNILQSIEVLCFRDRTMQGVRDITHSIIFEIKLPQGAFGPDCPKAVGWEKNQKGGMGPRVVNLSECMDPKRLAESSVDLNLKLMCWRLVPTLDLEKIVSAKCLLLGAGTLGCSVARTLMGWGVRKITFVDNARISYSNPVRQPLYEFEDCLSGGKPKALAAAERLQKIFPGVNSEGYNMSIPMPGHPVNFSEVTMAQARKDVATLEELIDAHDVVFLLMDTRESRWLPAVIAASKRKLVINAALGFDTFVVMRHGLKKPKQQETGNACFSTAPGPSDLLGSSLFSNIPGYKLGCYFCNDVVAPGDSTRDRTLDQQCTVSRPGLAMIAGALAVELMVSVLQHPEGGYAVASSSDDRMNEPPTSLGLVPHQIRGFLSRFDNVLPVSLAFDKCTACSPKVLDQYEREGFNFLAKVFNSSHSFLEDLTGLTLLHQETQAAEIWDMSDDETV

SEQ ID NO: 269 - protein, 647 aa, Caenorhabditis elegans
MATFVPFVTCLDTGFWNEVNKKKLNDWKLDETPKCISSQLSLHQTEGFKCHLSLSYDSLSSLESTTGLSMSGTLLLYNTIESFKMVDKSDLIRSEAEKIWESITTRKWLQNPRLLSQFFIIAFADLKKFKYYYWTCVPALVYPSEIKQEITPLSSLGADHKILFDFYRKNNFPIFLYSKQSSKMLELSELENNTNPDEICVVVADPSPVAYSAGWMVRNVLAAVAHLHPTWKHCHIISLRSADSIGIKYTWTLPSAECSADGAQNAVPKAVGWERNANDKLQPISVDLSKEFDPKILMERSVDLNLSLIKWRLHPDIQLERYSQLKVLILGAGTLGCNIARCLIGWGVRHISFLDNSTVSYNNPVRQSLSEFEDARLGRGKAETAQAAIQRIFPSIQATAHRLTVPMPGHSIDEKDVPELEKDIAKLEQLVKDHDVVFLALDSREARWLPTVLASRHKKIAISVAIGFDTYVIIRHGIGSRSESVSDVSSSDSVPYSQLSCYFCSDVTAPGNSTFDRTLDQQCTVARPGTSMIASGIAVELLSSVLQYPDPLKTPASHDDNTTVLGAAPHQIRGFLGRFQQILPSVKRFDQCVACGDAIAAQFQQNGWKFVRDVMNSPGRLEEVTGLDELQNSVNAIDIDFEDDEDF

SEQ ID NO: 270 - protein, 603 aa, Kluyveromyces lactis
MLNDLKFSPAFKSFVDTSFFHELSRLKLEVFKLDSAEKELFSALDLENITSNTVSLSLRDDSFDPVLNNEAVTLKGSVLNFNTIESFKSCDKVKFIKEKGQQLLEQGLKNGLKECVRFYVISFADLKKYKFYYWVCMPTFQSEGSSYEIISTKSIEDGVKKDIWEQNSFISCVVDGKIQEASPQYLKVCQKVIFKDFSRLKGIPAAVTKNFLTVWSQISTRNTYTICFLRDDNSSFAAEIRVTGSNTGCLKVSGWEKNGLGKLAPKSADLSSLMDPVKIAEQSIDLNLKLMKWRIAPDIDLERIKNIKALILGSGTLGCYVARALLAWGTRHVTFVDNSTVSFSNPVRQPLFNFEDCGRPKAEAASDSLKKIFPSVVSAGYQLEIPMIGHPVSNESKQRKDYEILDELIRTHDVIFLLMDARETRWLPSVLGRMHEKIVINAALGFDSYLVMRHGNNNDNLGCYFCNDIVAPSDSLTDRTLDQMCTVTRPGVALLAASQAVELLVTYLQPSTNVLGSAPHQIRGFLNEFKTVKLETPAYQHCCASNENVILTLKENGWNFVKQALDDYKCVEQLSGLSKVQEEAELAIQEDISFDDDEELSIE

SEQ ID NO: 271 - protein, 703 aa, Canis familiaris
MAAALGDPGLSKLLFAPFSSALDVGFWHELTQRKLNEYRLDEAPKDIKGYYYNGDSAGLPARLTLEFSAFDMSAPTPAHCCPAVGTLFNTNTLEAFKAADKKLLLEQAADEIWEAIKSGAALENPVLLNKFLLLTFADLKKYHFYYWFCFPALCLPESIPLIQGPVGLDQRFSPKQIQALEHAYDDLCQTEGVPALPYFLIKYDENMVLVSLLKHYSDFFQDQRTKITIGVYDPCNLAQHPGWPLRNLLVLAAHRWSSCFQSVEVLCFRDRTMQGMRDIAHSIIFEVKLPEMAFSPDCPKAVGWEKNQKGGMGPRMVNLSECMDPKRLAESSVDLNLKLMCWRLVPTLDLEKVVSVKCLLLGAGTLGCNVARTLMGWGVRHITFVDNANISYSNPVRQPLYEFEDCLAGGKPKALAAADRLQKIFPGVNARGFNMSIPMPGHPVNFSSVTLDQARRDVEQLEQLIESHDVVFLLMDTRESRWLPAVIAASKRKLVINAALGFDTFVVMRHGLKKPKQQGAGDLCSGHLVAPADLLGSSLFANIPGYKLGCYFCNDVVAPGDSTRDRTLDQQCTVSRPGLAMIAGALAVELMVSVLQHPEGGYAIASSSDDRMNEPPTSLGLVPHQIRGFLSRFDNVLPVSLAFDKCTACSSKVLDQYEREGFNFLAKVFNSSHSFLEDLTGLTLLHQETQAAEIWDMSDDETV

SEQ ID NO: 272 - protein, 125 aa, Homo sapiens; identical to SEQ ID NO: 199

SEQ ID NO: 273 - protein, 121 aa, Bos taurus
MPSDRPFKQRRSFADRCKEVQQIREQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 274 - protein, 121 aa, Mus musculus
MPSDRPFKQRRSFADRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 275 - protein, 121 aa, Rattus norvegicus; identical to SEQ ID NO: 274

SEQ ID NO: 276 - protein, 121 aa, Danio rerio
MPSDRPFKQRRSFADRCKEVQQIREQHPNKIPVIIERYKGEKQLPVLDKTKFLVPDHVNMSELVKIIRRRLQLNPTQAFFLLVNQHSMVSVSTPISEIYEQERDEDGFLYMVYASQETFGC

SEQ ID NO: 277 - protein, 121 aa, Pan troglodytes
MPSDRTFQQRRSFSDRCKEVQQIRDQHPSKIPVIIERYKGEKQLPVLDKTKFLVPDHVNMSELVKIIRRRLQLNPTQAFFLLVNQHSMVSVSTPIADIYEQEKDEDGFLYMVYASQETFGF

SEQ ID NO: 278 - protein, 125 aa, Gallus gallus
MPSEKSFKQRRTFEQRVEDVRLIRDQHPTKIPVIIERYKGEKQLPVLDKTKFLVPDHVNMSELIKIIRRRLQLNSNQAFFLLVNGHSMVSVSTPISEVYESEKDEDGFLYMVYASQETFGVQSSV

SEQ ID NO: 279 - protein, 125 aa, Rattus norvegicus
MPSEKTFKQRRSFEQRVEDVRLIREQHPTKIPVIIERYKGEKQLPVLDKTKFLVPDHVNMSELIKIIRRRLQLNANQAFFLLVNGHSMVSVSTPISEVYESERDEDGFLYMVYASQETFGTALAV

SEQ ID NO: 280 - protein, 125 aa, Mus musculus
MPSEKTFKQRRSFEQRVEDVRLIREQHPTKIPVIIERYKGEKQLPVLDKTKFLVPDHVNMSELIKIIRRRLQLNANQAFFLLVNGHSMVSVSTPISEVYESERDEDGFLYMVYASQETFGTAMAV

SEQ ID NO: 281 - protein, 122 aa, Danio rerio
MPSEKTFKQRRTFEQRVEDVRLIREQHPNKIPVIIERYKGEKQLPILDKTKFLVPDHVNMSELIKIIRRRLQLNSNQAFFLLVNGHSMVSVSTAISEVYERERDEDGFLYMVYASQETFGFQ

SEQ ID NO: 282 - protein, 588 aa, Pan troglodytes
MSSGLRAADFPRWKRHISEQLRRRDRLQRQAFEEIILQYNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSRRRQARLQKELAEAAKEPLPVEQDDDIEVIVDETSDHTEETSPVRAISRAATRRSVSSFPVPQDNVDTHPGSGKEVRVPTTALCVFDAHDGEVNAVQFSPGSRLLATGGMDRRVKLWEVFGEKCEFKGSLSGSNAGITSIEFDSAGSYLLAASNDFASRIWTVDDYRLRHTLTGHSGKVLSAKFLLDNARIVSGSHDRTLKLWDLRSKVCIKTVFAGSSCNDIVCTEQCVMSGHFDKKIRFWDIRSESIVREMELLGKITALDLNPERTELLSCSRDDLLKVIDLRTNAIKQTFSAPGFKCGSDWTRVVFSPDGSYVAAGSAEGSLYIWSVLTGKVEKVLSKQHSSSINAVAWSPSGSHVVSVDKGCKAVLWAQY

SEQ ID NO: 283 - protein, 125 aa, Canis familiaris
MPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLFV

SEQ ID NO: 284 - protein, 147 aa, Pan troglodytes
MPPPQKIPSVRPFKQRKSLAIRQEEVAGIRAKFPNKIPVIVERYPRETFLPLLDKTKFLVPQELTMTQFLSIIRSRMVLRATEAFYLLVNNKSLVSMSATMAEIYRDYKDEDGFVYMTYASQETFGCLESAAPRDGSSLEDRPCNPL

SEQ ID NO: 285 - protein, 169 aa, Canis familiaris
MQTPQKTQSLRPFKQRKSLATRQEEVAGIRAKFPNKIPVIVERYPREKFLPLLDKTKFLVPQELTMIQFLSIIRSRLVLGATEAFYLLVNNRSLVSMSMTMAEVYRDYKDEDGFVYMTYASQEMFGCLGSEQILPSSPVHVKNQCSNLRRDGSSPVCVVDNPVSEAAPQ

SEQ ID NO: 286 - protein, 839 aa, Homo sapiens; identical to SEQ ID NO: 201

SEQ ID NO: 287 - protein, 839 aa, Mus musculus
MAQFDTEYQRLEASYSDSPPGEEDLLVHVAEGSKSPWHHIENLDLFFSRVYNLHQKNGFTCMLIGEMFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEVVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSGGQTEASVYQQAEDGKTELSLMHFAITNPGWQPPRESTAFLGFLKEQVQRDGAAAGLAQGGLLPENALFTSIQSLQSESEPLSLIANVVAGSSCRGPSLSRDLQGSRHRADVASALRSFSPLQPGAAPQGRVPSTMTGSGVDARTASSGSSVWEGQLQSLVLSEYASTEMSLHALYMHQLHKQQTQAEPERHVWHRRESDESGESAPEEGGEGARAPQPIPRSASYPCATPRPGAPETTALHGGFQRRYGGITDPGTVPRGPSHFSRLPLGGWAEDGQPASRHPEPVPEEGSEDELPPQVHKV

SEQ ID NO: 288 - protein, 839 aa, Rattus norvegicus
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEVVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSGGQTEASVYQQAEDGKTELSLMHFAITNPGWQPPRESTAFLGFLKEQVQRDGAAAGLAQGGLLPENALFTSIQSLQSESEPLSLIANVVAGSSCRGPPLSRDLQGSRHRADVASALRSFSPLQPGQAPQGRVPSTMTGSGVDARTASSGSSVWEGQLQSLVLSEYASTEMSLHALYMHQLHKQQTQAEPERHVWHRRESDESGESAPEEGGEGARAPQPIPRSASYPCATPRPGAPETTALHGGFQRRYGGITDPGTVPRAPSHFSRLPLGGWAEDGQPASRHPEPVPEEGSEDELPPQVHKV

SEQ ID NO: 289 - protein, 839 aa, Bos taurus
MAQFDTEYQRLEASYSDSPPGEEDLLVHVPEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWVHRLIKFIYNICCYWEIHSFYLHALRIPMSALPYCTWQEVQARIVQTQKEHQICIHKRELTELDIYHRILRFQNYMVALVNKSLLPLRFRLPGLGEVVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNCAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSGGQTEASVYQQAEDGKTELSLMHFAITNPGWQPPRESTAFLGFLKEQVQRDGAAAGLAQGGLLPENALFTSIQSLQSESEPLSLIANVVAGSSCRGPPLPRDLQGSRHRAEVASALRSFSPLQPGQAPTGRAPSTMTGSGVDARTASSGSSVWEGQLQSLVLSEYASTEMSLHALYMHQLHKQQAQAEPERHVWHRRESDESGESAPEEGGEGARATQPIPRSASYPCAAPRPGAPETTALQGGFQRRYGGITDPGTVPRAPSHFSRLPLGGWAEDGQSASRHPEPVPEEGSEDELPPQVHKV

SEQ ID NO: 290 - protein, 840 aa, Gallus gallus
MAHLETQYQRLESSSTESPPGGGDLLVHVPEGAKSPWHHIENLDLFFSRVYNLHQKNGFTCMLIGEIFELMQFIFVVAFTTFLISCVDYDILFANKAVNHSQHPSEPIKVTLPDAFLPPNVCSARIQANSFLICILVIAGVFWIHRLVKFIYNICCYWEIHSFYINALRIPMSNLPYYTWQEVQARIVQIQKEHQICIHKKELTELDIYHRILRFKNYMVAMVNKSLLPIRFRLPLLGDTVFYTRGLKYNFELIFFWGPGSLFENEWSLKAEYKRAGNRLELAEKISTRILWIGIANFLLCPLILIWQILYAFFSYTEILKREPGSLGARCWSLYGRCYLRHFNELDHELQSRLSKGYKPASKYMNCFISPLLTIVAKNVAFFAGSILAVLIALTIYDEDVLAVEHVLTTVTLLGVGITVCRSFIPDQHLVFCPEQLLRVILAHIHYMPDHWQGNAHRYETRDEFAQLFQYKAVFILEELLSPIITPLILIICLRPKSLDIVDFFRNFTVEVVGVGDTCSFAQMDVRQHGHPAWMSAGKTEASIYQQAEDGKTELSLMHFAITNPKWQPPRESTAFIGFLKERVHRDSSVALAQQAVLPENALFSSIQSLQSESEPHSLIANVIAGSSVLGFHMGRDGQASRHLSEVASALRSFSPLQSAQQPSAGFQTGGSSAMTASGADARTMSSGSSAWEGQLQSMILSEYASTEMSLHALYMHELHKQHAQLEPERHTWHRRESDESGESTHEELDAQRGAPVPLPRSASYPFSSRQPAEETATLQTGFQRRYGGITDPGTVHRAPSHFSRLPLGGWAEDGQSARHPEPVPEESSEDELPPQIHKV

SEQ ID NO: 291 - protein, 316 aa, Oryza sativa
  misc_feature: Japonica cultivar-group
MQVKQKVYELYKGTVERVTGPRTVSAFLDKGVLSVPEFILAGDNLVSKCPTWSWEAGDPSKRKPYLPPDKQFLVTRNVPCLRRAVSLEEEYDAAGAEVVLGDDEDGEGWLATHGVQASKQEEEEDIPSMDTLDIGKTEGIKSIPSYFSAGKKAEEEEDIPDMDTYEDSGNDSVATAQPSYFVAEEPEDDNILRTRTYDVSITYDKYYQTPRVWLTGYDESRMPLKPELVFEDISQDHARKTVTIEDHPHLSAGKHASVHPCKHAAVMKKIIDVLMSQGVEPEVDKYLFIFLKFMASVIPTIEYDYTMDFDLGSTSR

SEQ ID NO: 292 - protein, 1042 aa, Oryza sativa
  misc_feature: Japonica cultivar-group
MAARAEAAAAAPRPLQAAAIGVCAETGFWDALRRLKLDVLGTDDSPIPITGYYTPRQYEKIASLFRICPESILPPSANSFGDRNNCPVPGTLLNTNNMRGFQNLDRALLLKAEAKKILHDIKSGKVEENPALLLRFLVISFADLKNWKVYYNVAFPSLIFDSKITLLSLKLASQVLKQEEATSLSNAFTEWRKSSETTVVPFFLINISPDSSATIRQLKDWKACQGNGQKLLFGFYDHGNRGFPGWALRNYIAFVSLRWKIEKVHFFCYREKRGRPDIQQSLVGEASFPAPHAGWDEPDYVPEAIGWEGETAGKESKEMKPKEIDLSSINPASQDEEKQLMHLKLMGWRHFPVNLDKLAGVRCLLLGAGTLGCEVARLLMTWGVRKLTVVDDGCVSMSDLVKQSLYTDKDCGVPRVTAIVPHLKERCSAVEVEGIQMGIPKLEYNISASKISSITDDCKRLQTLVDSNDVVFLLNETWEGMWLPTLLCADKNKIAITVLLGYDNYLVMRHGAGPGTKSGGMDEGIAQIENLSTQDALGRQRLGCCFCSDTTSLVNSDHNGALDQQSAVILPGLTSVASGKAVELFARMLHHPDEIHAPGDIAGTDTEHQLGLLPHQMQGSLSKCVLSTVLCNSSSNCIACSNAVLSEYRRRGFDFVTQAITCPTYLKDLTGISDLKKPFASKISASIPVSKTSASIPVNLEKLSSARCLLLGAGTLGCDVARILMDCGVRKLTVVDSGRVVVSNLARQSLYTSDDRDSPKASAILGRLKERCPSVDAKGIKMEIPMPGHPVSPNEAVSVLEDCKRLQELVSSHDAVFLLTDTRESRWLPTLLCANENKIAITAALGYDSYLVMRHGAGPGTNCGSPDVVAAADTLSAEDVLGRQRLGCYFCNDVVAPVDSVSNRTLDQQCTVTRPGLSSITSGCAADLFTRMLHHPDGIHAPGEIAGTSSEGPLGLLPHQIRGSLSQYNLLTLLGYSSSNCTACSNAVLSEYHRRGMDFVMQVINEPTYLEDLTGLTDLMKSAAYSQVEWIDEVDDDDEMDI

SEQ ID NO: 293 - protein, 500 aa, Oryza sativa
  misc_feature: Japonica cultivar-group
MKAPAAAAAAVGNRAGGVDPSIPRFKCQECHRALVVVGVDSFADKLPAQATSAHASSVHGSIMGASRMDNSYVVLSKQNKSHGHGIPPRPPSAAAPHIEPNQPTRAMEGSYIVLPPAAASIYKTSTSEGGGAQLPPPSINSSSLLPGNSFHSNVTVLKRAFEIATSQTQVEQPMCLDCMRLLSDKMDKEIEDVNADIKAYEVCLQHLEQESHTVLSDAGFQKEKLKIEEEEKKLNAAIEEAEKQYSEISSEMKDLEIKSKEFEELEERYWHEFNSFQFQLTSHQEERDAILAKIEVSQVHLELLKQTNVLNDAFYISHDGVIGTINNFRLGRLPNVQVEWDEINAAWGQAALLLHTMAQYFTPKFEYRIKIHPMGSYPRVTDIHKNTYELFGPVNLFWSTRFDKAMTWFLTCLQDFAEFAISLDKENNVPPEKSLKLPYKIDGDKVGSHTIFLSFNKVENWTKALKYTLCNLKWVLYWFIGNTSFAPPSGSLCAAQSSKR

SEQ ID NO: 294 - protein, 380 aa, Oryza sativa
  misc_feature: Japonica cultivar-group
MAAQRDDEAGWSAEAARRVWGGAVPLQVHLHDADVTTLPPPPPFLTLGPRIGYLPLLVPIIKAHFSSTLPPGIDTVWFEYKGLPLKWYIPIGVLYDLLCADPERPWNLTVHFRGYPSEILTLCDGEDSVKWSYMNSLKEAAFIITGNSKNVMNMSQADQGALWQSVMKGNLDGYMNISTRLKLGPFEEDCLVRTSSVEGQQGSDEPESPGSGKPCRVPVRLYVRSVQEDLYDLEDALPVGDWESISYINRPFEVRREEGRSYITLEHALKTLLPEFFSSKASRIPDDSETAPQAPDSAPNDDSDVTPRSCEKLESSASSSPQEANVANKGKIVKLVRVQGIEVDMDIPFLWVANNLKNPECYLHICVYVGTRKREPKDGR

SEQ ID NO: 295 - protein, 902 aa, Oryza sativa
  misc_feature: Japonica cultivar-group
MMSFRSKDRNVQPRFNWPWRSESPLSAQLLIDIPPEIELSDYRRLPGSGSESPSGLLHGEGFKDEPIADLDIFFERLYEYFCAKGLRCIVTKWIIEMLNVLFMVCCIGFFFLIVDWNALGHLKCGVEALESGEKPCDLMQVVKHNPLVPFTFPKMITIGSMVILTTYGLINFLKFFVQLRSTLNIRDFYCNSLKITDLEIQTISWPKIIEKVVLLQKSQKLCVVRDLSEHDIIMRIMRKENYLIGMVNKGIISFPIRPWVPGAGPTVKSHLQNRRNHLILPKALEWTLNWCIFQSMFDSKFCVRKDFLTSPAVLKKRLVFVGISMLILSPCLVIFPLVYLILRHAEEIYNHPSTASSRRWSNLSRWIFREYNEVDHFFRHRMNNSAVHSLNYLKQFPTPLISIMAKFISFVSGGLAGALIIIGFLGESVLEGHIFGRNLFWYTIVFGTIAAISRKVVADELQVIDPEGAMCNVVQQTHYMPKRWRGKEDSEVVRREFETLFQFTIVMLLEEMASIFISPYLLIFEVPKRVDDILRFISDFTIYVDGVGDVCSLSLFDFRRHGNRNYASPFDALKTLRSSQGKMEKSFLSFQSVYPSWEPNAEGKQFLTNLQKFKEKQIRQQALAQYQAMEASGFVASTRGHRDDIFHQLLPSDIHNRAEAISPAVYNLGPLGLLDTDQRSHPYILDWYYVCHPPHLDRTEAPYFNEVFPETSENTGSAAFKASEIEEARGWDSDMVPPPRADRDEWNFNHERVRSHMDASTSSNLFHHAPVEHHDTKGNIIDWWDQAPEHSTGQQGSFLEPPEFGNRYVAGNRSSYHSGDVSDGSVEELERSYNRSSSSWRRPQDLSTTRYMDDSDIEEGLNLPFADLPQKDEDARHGTSDTNDPTPVGLPVRIIPRSSDPV

SEQ ID NO: 296 - protein, 524 aa, Oryza sativa
  misc_feature: Japonica cultivar-group
MKEDESPPHPHRSIPFHPSPPRDGSDSGGSVAAVPPSPRAAAAAAARPPVMTSLPGRGVSPSSSDPLCEGNAAPSSSSSSGQDLKQLKNSILSCVFSSPFSIFEAHQDSSANRSLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPYSPEYIGILHMFGDSEACAFSIHNLLQAGKSYGLAAGSWVGPYAMCRAWQTLVCTNREHHEAVDGNGNFPMALYVVSGDEDGERGGAPVVCIDVAAQLCCDFNKNQSTWSPILLLVPLVLGLDKLNPRYIPLLKETLTFPQSLGILGGKPGTSTYIAGVQDDRALYLDPHEVQLAVDIAADNLEAGTSSYHCSTVRDLALDLIDPSLAIGFYCRDKDDFDDFCSRASELVDKANGAPLFTVVQSVQPSKQMYNEESSSGDGMDSINVEGLDGSGETGEEEWQIL

SEQ ID NO: 297 - protein, 511 aa, Oryza sativa
  misc_feature: Japonica cultivar-group
MTMVEAEAGKEAIRRALRSLRRRHLVEEGAHRPAIEALARPFAAQAVEWKEKAEKHELELQQCYKAQSRLSEQLVTEIEEGKASKALLKEKETLITTMQTELEQTREENTQLKQSLEEKTSALDLIIQEHQAVKAELEQALTKQKVAEDENRNLIDRWMLEKMKDAERLNEANAMYEEMVLKLKSAGVGGIQHNALQEADGIIRRSEAGYMDIMETPIPSTCRITIRAHDGGCGSIIFQHNTDKLISGGQDQTVKIWSAHTGALTSTLQGCLGSVNDLAVTNDNKFVIAACSSNKLFVWEVNGGRPRHTLTGHTKNVSSVDASWVKSCVLASSSNDHTIKIWDLQSGFCKSTIMSGSNANSLAFIDGVTLCSGHRDGHLRLWDIRSAKCTSQTFAHLDVSSVSVSRNRNFILTSGKDNVHNLFDPRTMEVCGKFKAMGNRVVSSWGRPCISPDENSIAAGANDGSVYIWSRLKKDGVPTILQGHSSSVVSSSWCGLGPLATADKHHIYIWT

SEQ ID NO: 298 - protein, 478 aa, Oryza sativa
  misc_feature: Japonica cultivar-group
MTSLPDRGVSSSSSDPLCEGNIAPCSSSSEQKEDCSLKQSKTSILSCVFNSPFNIFEAHQDSSANKSPKSSSGSYDWSRVLRRIVCSGSMWRFLGTSKVLTSSDVWFLGKCYKLSSEESSSDSDSESGHATFLEDFSSRIWITYRRGFDAISDSKYTSDVNWGCMVRSSQMLVAQALIFHHLGRSWRRPLEKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGETGEEEWQIL

SEQ ID NO: 299 - protein, 845 aa, Drosophila melanogaster
MSSPHINYRSLAEEAASPFLEHHPSTGQGPSKTQDAKANAAAAHLDPLGEHGLEQPLDEHDTEHEGEDTPRNSGVMIHMVPETGRARWNHIEDLDSFFSRMYQYQQKHGFTVIVVDEMLQVLEFGFVVWLLAFVMHCVRFDVLFGDTPPGGLNPNKTTLSDVMYPTGECLANFTWVTYLVVFIAAIYLGIRLLKMVYHITQYADIKRFYNSALHIEDSDLDNFTWHEVQQRIRRVQAEQHMCIDKESLTELDIYHRVLRFKNYLVALMNKQLLPVRFHIPLYGEVVSLSRGMLFNIDFILFRGPGSPFQNNWQLRDEFAVRSNQTELAQRLSKLILGVALLNLVLAPVIFVWQLIYFSFSYANILRKEPGALGLRTWSNYGRLYLRHFNELDHELDARLNRAYDYADRYLNSFSSPLAAVIAKNLLFISGGLLLLILALGIYEEHVFQVEHLLAILAGLGAIGVVCRTLIPDENLVWCPEQLMTAILAHVHYLPSEWRQQAHTTKVRQEFSNFFQFKAGYLLSEIFSPFVTPFVLIFVFRPKAIELVRFFRTFTVSVRGVGNVCSFAQMDVRKHGNPDWQLTSELEEMTRATAQQPQQEPQQQSLAGGKTEMSLLRFTLNNPEWQMPKEAKQFLRGVREHAVGELVQAKTSMVQENPLTNSLISFGTMGADYCSIANSVLTAQVTPQQLEISQSLRPGLGPVSGGFPVAASDFRQMLQQNLSASVGPLDSMRRLRLSRAEGRLEGPTDTLLYGLCGVDPRVGSTPLNVGVADMCLSALYLHELNQQKRQARQSRIDEAEDERPGTSHWPPRPPAAPSADTGFGSRHTVITSKAAESTPLLGSIRS

SEQ ID NO: 300 - protein, 866 aa, Arabidopsis thaliana
MMSSGHKGPNVRNFFKWQRGESSSSLTTGLLHNESHEIELSNYGGIPSPGSESPSGLLNGESLNVQPIADLDLFVERLYSYYRDKGLWCIIVKWAVELLSLGFIICFSGFFLLYVDWNGLQNAKCGMDAVESGTKPCDLVKEAIHPHPLSPFTLTTAIIVGYLALFSVYWLFCFLRFFAQLKDTLDFRHFYYNNLHVTDNEILTMPWATVLEKVVQLQSSQCLCVVKDLSAHDMVMRLMRKENYLIGMLNKGLLSFPISHWIPGAGPAVKSAPDGTQYHLVLTKTLEWTLNWCILQSMFDCNFRVRRDFVSNPTTLKKRLFVVGLAMLLLSPFLVIFMLVYLFLRHAEQFYNHPSTASSRRWSNLSKWLFREFNEVDHLFKHRINSSVVHASEYLKQFPSPIISIIAKFVSFVSGGFAAVLIIIAFLEESLLEGHIFGRNLFWYAAVFGTITAISRAAISDELLVLDPVGTMSLVVQNTHYMPKRWRGKENKDDVRLELETLFQYTGMMLLEEIASIFITPFLLMFVVPKRVDDILQFIKDFTVDIEGVGHVCSFSAFYFENHGNIKYGSPHNATRREQRSSQGKMEKSFLSFQSSYPSWESDSLGKQFLSNLRTFRDRKLHEINTRHSSPSRAWRESTNTPALYRDIPRNPLASGNHTDSMWLIDPDQRNHPYLLDWYYTSQAHNRTDHPIERANEILTANQNATDCWPPDLGIRGEDSRDLLNMEASTSGQFFRESILRHDQPEGEDSYGSQHPLDGRNQWWGRGNHSQISTAHPATTNSFIEPPDFINRYTAGNLLDNSWSRRSIEEEDEEEEELDWEENARRNLSRTTFMDDNDIEAGIDLHFDDVYSSRPQETSTSSTTLR

SEQ ID NO: 301 - protein, 719 aa, Caenorhabditis elegans
MAETQNLLQKIDNSSINLIFFQKKTHQMFNSQSKRAYQQIDDDFDDEVLRNSTCTSRFMQGWGSSTRSLLFGGASNDEQRNLIASSSSHHSYHDSPAEEPPETHYEQFTATHNHGPPTMASSSQLNSRRWDHVLNLDEFFTHIYEYHQNGGYLCIVLQKVFSLLQFIFVMSFTTFFTQCVNYQFLFANTNVTSHGTVNQGKRHFGDAVVDNCPAHISIWMIFAILAAIVYWITRVIKHAQYIMKMSEIQQFYAHELKIADDQLPNLTWHAIVKRICEAQKKLRLSIHQDNITSIYIYHRILRYKNYMTGMINKRILHPVFDVPFLGPIAYLPNNLKHEIERILFTSSTSAWTNGPNLREEYKHHEQLDMAAKKMKEDVINLFLQILRISVARPDASTAPIPDYGIVLLTDGAHKKTTRWAWNEKIQYLLRHFNELDHELSARLNRSHIYAAAYMDQFFSPVLEIAAKNITFIAAAVFGVLTILSAWDEDVLQVEHVITVLTICGIVVLVCRGMIPDENLVWQPEILMTHVTSELHYLPSTWKGKAHTTGVRHEFDQLFQMKWMFFVLELTSPIFTPFVLLFWLRPRCSQLANFFHDYTERVDGLGDVCSFAVMDVGKHGDPKWNHIKELKAIVEDQEDQQQAQSVVTSLNRARDGKTELSILHFKTTNPEWQPPKASEKFLRKFRNRLGQEASMLAPLTSMHLGQQMDRQQQQGKIGKK

SEQ ID NO: 302 - protein, 897 aa, Ashbya gossypii
  misc_feature: ATCC 10895
MEQSEDTIQHERKNTFLSRVFGVHSSEVGDSIETAELSQYPIQIARSGSNAIDESRVIESDQASSSEEEDTDGHDLSVAENMTSYNGAQGSGSEDSDVPFSDQELETIETYTIAKVGQGSSSEDDRLQADSAEEEDALLFQHRLQDGSKGRNKVSSQPLGLKRILGSKGKSILGKEPASQEDSFIFRKGPTWDEENQLRPESKRPGLLSGKSNARLSSPSRPSPLSARERALWKWANVENLDGFLQDVYSYYLGNGFYCIMIEKILNLLTLLFIVFISTYMSHCIDYSKLPNGHKFSDVRVDQCYETQITGTTKLLFWIFGVFVVLKVVQMYFDFRRIHEIHNFYTYLLNISDKELQTIPWQSVIHQIMRLKDQNAVTANVVEVKAKNHIDAHDVANRIMRKENYLIALYNKDILHLSLPIPLYRTSTLTKTLEWNIHLCIIGFAFNEAGFLKQSFLNPAQREFLSEELKKRFILAGFLNIILAPFLVVYFVLLYFFRYFNEYKTSPGSLSTRQYTPIAEWKFREYNELYHLFKKRMGLSYEVANTYINQFPNALGDYFFKFVKFISGSFVAILALMTVLDPENFLNFELTADRTVLFYMTVLGTIWAVCHSAVNDNCSVFDPEDSLKELITYIHYAPKEWDGRYHTDEVKQEFCKLYNLRVILLLRELASLIMTPFILWFSLPNSAESIVDFFREVTVYGDGLGYVCKYAMFDENCKKGLRTNKHLQGTQTKYGHSLGDDHDSSDEETDKGMNKMIQSYMYFVDDYQNSVNAVGKYQIPKTQNLSHESKYNMKSHQHYSWKKQFKLGSKPEDFKIGSVTPRALSSSILANKPKSNLRARLDPEISHSNVQFDDLGESFINSIPVADYDPIERSDAMGGNGVLGLLNQYYRKSDVGR

SEQ ID NO: 303 - protein, 839 aa, Pan troglodytes
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRALSHFSRLPLGGWAEDGQSASRHPEPVPEEGSEDELPPQVHKV

SEQ ID NO: 304 - protein, 907 aa, Anopheles gambiae str. PEST
MTTSRQFDAKTYDTLTNQDTNPFADKRSPTIEEEDTPQVIHVVPETSKARWNHIEDLDSFFTRVYIYHQKHGFYVMMLQKLFELFQFVFVVVLITYMFNCIDYAILFRDKIIDQESKVSLGDAMIGVSECAANLGAFQWMALVLAGLFWTFRLFKFFYQFFQFWDIKMFYNTALKIEDADLDNLTWHEVQKCIREVQSEIQMSINKEQLTELDIYHRILRFKNYMVAMMNKSLLPATTKLPLLGNVVLMSQALRYNIGLILFWGPWSPFENSWHLREEYKRPSMRNELAAKLSKQILWVAIANFILSPFIFICQLMYFFFNYADLIKKEPGTLGVRCWSQYGKLYLRHFNELDHELDARLTRAYRPAVKYMNSFSSPLLTVIARNIAFDAGGVASLILLLAIYDEDVFQVQHVLTLFTILGMISVIARSLIPDENMVWCPEQLLRNVLAHVHYLPSVWRGHAHSSVVRDQFELFFQLKIMYILNELFSPLVAPFVLLYDLRPKSQQLVDFFRNFTVDVVGVGDVCSFAQMDVRKHGNPDWQIPVVADDKDMRPAGAGAGAAAAQYNQGEHGKTELSLVHFTLTNPTWQMPPEAKQFVQGIKRHALHDLNRQRGMMLGLHNPTAMGQSLLSVESMGAEYSSIIQPILQTHNLSNSQHLGLSMHLGGGGFGSPVPPMTPGYGPAGMMPSTVQQQQQQQPTAQHGGAGVQSSHQYHFGPQSYDFERMLQQNLTDASTVAPNMPARSTFLADIHENDDESAGAPPALMPELEEGSRYAAPYATDGMVYSTRGGMSRREGPAGGSRTGLLSSLYGELPTNVPAPYEFTTADMCLSTLYLHELHHNHLRRHGGSLRLDMGSPPPPPSSGSSQRPTTTATFSSRFMGPGGIRPSRSMGGSAAAERTPLLGSKKS

SEQ ID NO: 305 - protein, 908 aa, Kluyveromyces lactis
MTDSQDKVNGGSKNTFLSRVFGVHSSAVENSLDAAEMSHITMPTEQDFSNYAEDEGNVRLIESDQEPSSSNEDSNDEEPLIQQPQSIRFDTASDGMATIQSESEPDEGGTEEDEVHLEEEDFSDQDLASSVSKYGQPSSSEDEEPLSNRDSNRGSDETIPFIGRQRLNLGGKNPITGATKSTKNPSESRVFERLLGNSPAKMFRNNGRPNNLEESFLFRKPSVAEQSGPGKSTHFNLKPPPIFNNISTLTSTSKNSLSSLSPKERALWKWANIENLDTFLQQVYEYYLGNGFYCIITEKVIHLATILFVVFISTYMGHCIDYSRLSSSHTFEEIHIEQCYKTQISPTAKVFLWIFYAFIGLKVLQLYFDVKALKDIRNFYNYLLSISDKDLQTIPWQSVIQQLVLLKDQNAITANATEVKAKNRLSAHDVANRIMRKENFVIALYDNNILDLSLPVPLLRTCALTKTLEWNINLCILGFAFNEKGYLKQAFLRESQREYLGEELKKRFVLAGFLNIILSPFLVTYFVLLNFFRYFNEYKTSPGSIGSRQYTPIAEWKFREYNELYHIFQKRMRLSMIIADNYVNQFPNTLLSLTLSFIQFVSGSFVAILGILTIFDPDNFLNFEITPDRTVLFYMTVFGTLWAVCHSSINDEYTVLKPEETLEELVSYTHYAPKEWKGKYHTEDIKNEFCRLYNLRITLLLRELVSIIITPFILWFSLPKNSERIIDFFRECTVYEEGLGYVCKYAMFEATKIDKGTKAKKQTKRMFSQAEQDDSETESDEGVNKMLQSYMYFVDDYKNAGNAVGKNQLPASPIEPSYHPYSSTKDYSWKTQFALGKNSNRKRNLNRSRVKRFPDRSSDLELGSLSGSLINKSTLFKDDIADNADELKAGNGVMGLLNQYYKKSDRNR

SEQ ID NO: 306 - protein, 839 aa, Canis familiaris
MAQFDTEYQRLEASYSDSPPGEEDLLVHVPEGSKSPWHHIENLDLFFSRVYNLHQKNGFTCMLIGEVFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSGGQTEASVYQQAEDGKTELSLMHFAITNPGWQPPRESTAFLGFLKEQVQRDGAAAGLAQGGLLPENALFTSIQSLQSESEPLSLIANVVAGSSCRGPPLPRDLQGSRHRAEVASALRSFSPLHPGQVPAGRAPSTMTGSGVDARTASSGSSVWEGQLQSLVLSEYASTEMSLHALYMHQLHKQQAQAEPERHVWHRRESDESGESAPEEGGEGSRASQPIPRSASYPCAAPRPGAPETTALQGGFQRRYGGITDPGTVPRAPSHFSRLPLGGWAEDGQSASRHPEPVPEEGSEDELPPQVHKV

SEQ ID NO: 307 - protein, 846 aa, Danio rerio
MAHFDTEYQRLEASYSDSPPGEENLLVHVPEGSKSPWHHIENLDLFFQRVYNLHQKNGFTCMLLGEIFELVQLVFVVAFTVFLANCVDYDILFANKFVNHTDSLKVTLPDAFLPVDVCSARIRDSVPVIFILVISGVFWLHRLVKFIYNICCYWEIRSFYINALKISMADLPYFTWQEVQARIVEIQKEHQICIHKKELSELDIYHRILRFKNYMVAMVNKSLLPVRFRLPVLGDTVFYTRGLKYNFELIFFWGPGSLFENEWSLKSEYKRGGNRLELADRLSSRILWIGIANLLLCPVILIWQILYAFFSYTEVIKREPGSLGARCWSLYGRFYLRHFNELDHELMSRLSKGYKASSKYMNCFMSPLLTVVAKNVAFFAGSILAVLIALTIYDEDVLAVEHVLSSITLLGVCITVCRSFIPDKHMVFCPEQLLKVILAHIHYMPDHWQGNAHRYETRDEFAQLFQYKAVFILEELLSPVITPFILIFCLRRKSLEIIDFFRNFTVDVVGVGDTCSFAQMDVRQHGHPAWMSAGKTEASIYQQAEDGKTELSLMHFAITNPHWQPPRESTHFISLLKEKVHRDAAVGQQGIIAENAGFTSTHSLHNDSEPRSLIANLLMGPPSLASLHLGREGSINHVSIGVSEGASALRSLSPVSTSLHLRGSYPSARLPRSDHPAVVAGRGMAGSGTDARTISSGSSAWEGQLTSMILSEYASTEMSIHALYMHEMHKQQSRGELSRHTWHRQESDESSESVNEDVEAARNFPRSSTFPCTTTSHQEGAAAQQSGSQRRQGGTSDPSSGSFRVQRTPRMAMGGWSEENQTSRHHDPVPEEGSEDELPPHIHKVT

SEQ ID NO: 308 - protein, 447 aa, Gallus gallus
MEGGRAPACTTQVSFVCQRCSQPLKLDTSFKILDRLTIQELTAPPLTAAPARPGDAQEESALSEEAFTEGRQDGVSRRFIPPARMMSTESANSFTLIGEASDGGTMENLSRRLKVTGDLFDIMSGQTDVDHPLCEECTDTLLDQLDTQLNITENECQNYKRCLEILEKMNEDDKEKLQTELKELALEEEQLIQELEDVEKNRKIVAEDFERVRAEAERLEQEEAQYQKEYCEFKRQQLELDDELKSVENQMRYAQMQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 309 - protein, 448 aa, Bos taurus
MEGSKTSSSTMQVSFVCQRCSQPLKLDTSFKILDRVTIQELTAPLLATAQLKPGETQEEEANSGEEPFIETRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLGLELKELALEEERLIQELEDVEKNRKIVAENLEKVQAEAERLDQEEAQYQREYSEFKRQQLELDDELKSVENQMRYAQMQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 310 - protein, 448 aa, Rattus norvegicus
MEGSKASSSTMQVSFVCQRCSQPLKLDTSFKILDRVTIQELTAPLLTTAQAKPGESQEEEANSGEEPFIETRQDGVSRRFIPPARMMSTESANSFTLIGEASDGGTMENLSRRLKVTGDLFDIMSGQTDVDHPLCEECTDTLLDQLDTQLNVTENECQNYKRCLEMLEQMNEGDSEQLQRELKELALEEERLIQELEDVEKNRKVVAENLEKVQAEAERLDQEEAQYQREYSEFKRQQLELDDELKSVENQMRYAQMQLDKLKKTNVFNATFHIWHSGQFGTINNFRLGRLPSAPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 311 - protein, 450 aa, Homo sapiens; identical to SEQ ID NO: 205

SEQ ID NO: 312 - protein, 448 aa, Mus musculus
MEGSKASSSTMQVSFVCQRCSQPLKLDTSFKILDRVTIQELTAPLLTTAQAKPGETQEEEANSGEEPFIETRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQRELKELALEEERLIQELEDVEKNRKVVAENLEKVQAEAERLDQEEAQYQREYSEFKRQQLELDDELKSVENQVRYAQIQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 313 - protein, 451 aa, Ashbya gossypii
  misc_feature: ATCC 10895
MSTPSFKCQNCQCPIDMDLSLMDLSIAQRDMIVNSGGEPTNPSTFKIPPERLSRLHQVRRPHELTVAAAPGAAESYVFLQVNEDGLNRSKHAIEEESGEEEEDDSSKTLSSNIQVLTNIFNILSSKGNIDYPVCHVCCELMMQRLKAEYADAIRKRDAYFEFMDRLQKQHEKESAQEPKPASAEADLLAQKDELVTKLVALEHENDKLDKEIESLEQQLREKEQQETRAVLKQNLKDLEHIAFMKDMQSLKNQYELTLNNLDKLRKTNIFNETFRISHSGPFGTINDLRLGGFSQVRVPWQEINAAMGQLILLLATIAAKIHYELDGYRLKPLGSYSKVERFDPHTQRWNVYNAYSNDDFKIGKLFHKETSLDKALEAIIAIVDQIAKRISTLSRDHNDGGMELPYSMQKDKINGIPIKLLGSDPTLEWTTSCKFLLTNAKWLLAFSSQVT

SEQ ID NO: 314 - protein, 450 aa, Pan troglodytes
MEGSKTSNNSTMQVSFVCQRCSQPLKLDTSFKILDRVTIQELTAPLLTTAQAKPGETQEEETNSGEEPFIETPRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQMELKELALEEERLIQELEDVEKNRKTVAENLEKVQAEAERLDQEEAQYQREYSEFKRQQLELDDELKSVENQMRYAQTQLDKLKKTNVFNATFHIWHSGQFGTINNFRLGRLPSVPVEWNEINAAWGQTVLLLHALANKMGLKFQRYRLVPYGNHSYLESLTDKSKELPLYCSGGLRFFWDNKFDHAMVAFLDCVQQFKEEVEKGETRFCLPYRMDVEKGKIEDTGGSGGSYSIKTQFNSEEQWTKALKFMLTNLKWGLAWVSSQFYNK

SEQ ID NO: 315 - protein, 463 aa, Danio rerio
METKGTDEVETLKSKFMSAWHSVKYSWALKSKTAFSRNSPVFLLGKCYHFKVVDDENPTESTAEALDDDVVTGNVDEFRKDFTSRVWLTYREEFPALPGSSFTSDCGWGCTLRAGQMILAQALLLHILGRDWKWSEALSLEPLDTETWTSSAARRLVATLEASIQGERAQASQPLCPVQGEAEEADSYLKETYHRTIVSWFGDGPSAQLGIYKLVELGMTSGKQAGDWYGPAVVAHILRKAVDEAVDAMLKGIRVYVAQDCTVYSADVIDSHSTRTESHSDPQGLDSGASPDSRAVVILIPVRLGGEKINPEYLNFVKSILSLEYCIGIIGGKPKQAYYFVGFQDDSLIYMDPHYCQSFVDVSTSDFPLQSFHCPSPKKMSFSKMDPSCTIGFYSKSVEHFEKIANELSKILQPSSKEKYPAFTIMKGHGKDYELSIAVEKREWPFIRDARKAGTTSGDFVLL

SEQ ID NO: 316 - protein, 147 aa, Homo sapiens
MPPPQKIPSVRPFKQRKSLAIRQEEVAGIRAKFPNKIPVVVERYPRETFLPPLDKTKFLVPQELTMTQFLSIIRSRMVLRATEAFYLLVNNKSLVSMSATMAEIYRDYKDEDGFVYMTYASQETFGCLESAAPRDGSSLEDRPCNPL

SEQ ID NO: 317 - protein, 464 aa, Schizosaccharomyces pombe
  misc_feature: 972h-
MQYLCQRCHSLINFKDVYDDDLLKLKNLPKSRFVQASSLTEMNESGESDDQMNSSSEDYPAQRLQLYKKTISEGDYNFDNVPPPELRTPTLDSFVVLPAAKDGYEEEKNSPEEVNDLFSWKIEIYNRIFDLLSSKTKVDHPLCVECAELLTEEMSKTLRALKEEKKMYFNYDNFLSSQTVHEENTAALDSEIDELMKQINEKEEKIEEISDETDKLQKLLRELDEEKEKVYAEEQEFYNNLNQFQIKKLSLERQYDCANLEFEHNSRKLEKLQKMNVFSDIFYISHYSEPNGEGSIATINGLRLGRLPSQKVNWAEINAAWGMTVLLLDVLTEKLDFHSSSYQLKPFGSQSFIIRFDRDPNGNQVKPTKLDLFSSGELKIFMNRRFDQGMVAFLDYLHQFGDFCAAKTPSAVLPYAIENDRIGGKCIRLAFNQDENWTRALKFVLTDIKFLEAYVSSQDKQSNF

SEQ ID NO: 318 - protein, 224 aa, Rattus norvegicus
MDNTVVMEEIRRLCRASLPCAGAAALSMESERHCNGLPAGAEVTNRPLAWRPLVLLIPLRLGLTDINEAYVETLKHCFMMPQSLGVIGGKPNSAHYFIGYVGEELIYLDPHTTQPAVELTDSCFIPDESFHCQHPPCRMGIGELDPSIAVGFFCKTEEDFNDWCQQVKKLSQLGGALPMFELVEQQPSHLACQDVLNLSLDSSDVERLERFFDSEDEDFEILSL

SEQ ID NO: 319 - protein, 997 aa, Saccharomyces cerevisiae
MERDEYQLPNSHGKNTFLSRIFGLQSDEVNPSLNSQEMSNFPLPDIERGSSLLHSTNDSREDVDENDLRVPESDQGTSTEEEDEVDEEQVQAYAPQISDGLDGDHQLNSVTSKENVLETEKSNLERLVEGSTDDSVPKVGQLSSEEEEDNEFINNDGFDDDTPLFQKSKIHEFSSKKSNTIEDGKRPLFFRHILQNNRPQRDTQKLFTSSNAIHHDKDKSANNGPRNINGNQKHGTKYFGSATQPRFTGSPLNNTNRFTKLFPLRKPNLLSNISVLNNTPEDRINTLSVKERALWKWANVENLDIFLQDVYNYYLGNGFYCIILEKILNICTLLFVVFVSTYMGHCVDYSKLPTSHRVSDIIIDKCYSNSITGFTKFFLWMFYFFVILKIVQLYFDVQKLSELQNFYKYLLNISDDELQTLPWQNVIQQLMYLKDQNAMTANVVEVKAKNRIDAHDVANRIMRRENYLIALYNSDILNLSLPIPLFRTNVLTKTLEWNINLCVMGFVFNESGFIKQSILKPSQREFTREELQKRFMLAGFLNIILAPFLVTYFVLLYFFRYFNEYKTSPGSIGARQYTPIAEWKFREYNELYHIFKKRISLSTTLANKYVDQFPKEKTNLFLKFVSFICGSFVAILAFLTVFDPENFLNFEITSDRSVIFYITILGAIWSVSRNTITQEYHVFDPEETLKELYEYTHYLPKEWEGRYHKEEIKLEFCKLYNLRIVILLRELTSLMITPFVLWFSLPSSAGRIVDFFRENSEYVDGLGYVCKYAMFNMKNIDGEDTHSMDEDSLTKKIAVNGSHTLNSKRRSKFTAEDHSDKDLANNKMLQSYVYFMDDYSNSENLTGKYQLPAKKGYPNNEGDSFLNNKYSWRKQFQPGQKPELFRIGKHALGPGHNISPAIYSTRNPGKNWDNNNNGDDIKNGTNNATAKNDDNNGNNDHEYVLTESFLDSGAFPNHDVIDHNKMLNSNYNGNGILNKGGVLGLVKEYYKKSDVGR

SEQ ID NO: 320 - protein, 630 aa, Saccharomyces cerevisiae
MSSERVLSYAPAFKSFLDTSFFQELSRLKLDVLKLDSTCQPLTVNLDLHNIPKSADQVPLFLTNRSFEKHNNKRTNEVPLQGSIFNFNVLDEFKNLDKQLFLHQRALECWEDGIKDINKCVSFVIISFADLKKYRFYYWLGVPCFQRPSSTVLHVRPEPSLKGLFSKCQKWFDVNYSKWVCILDADDEIVNYDKCIIRKTKVLAIRDTSTMENVPSALTKNFLSVLQYDVPDLIDFKLLIIRQNEGSFALNATFASIDPQSSSSNPDMKVSGWERNVQGKLAPRVVDLSSLLDPLKIADQSVDLNLKLMKWRILPDLNLDIIKNTKVLLLGAGTLGCYVSRALIAWGVRKITFVDNGTVSYSNPVRQALYNFEDCGKPKAELAAASLKRIFPLMDATGVKLSIPMIGHKLVNEEAQHKDFDRLRALIKEHDIIFLLVDSRESRWLPSLLSNIENKTVINAALGFDSYLVMRHGNRDEQSSKQLGCYFCHDVVAPTDSLTDRTLDQMCTVTRPGVAMMASSLAVELMTSLLQTKYSGSETTVLGDIPHQIRGFLHNFSILKLETPAYEHCPACSPKVIEAFTDLGWEFVKKALEHPLYLEEISGLSVIKQEVERLGNDVFEWEDDESDEIA

SEQ ID NO: 321 - protein, 557 aa, Saccharomyces cerevisiae
MKCQTCHLPLQLDPSLEGLSLTQRNLLLSNNSIITATNENVISNKGIEAADNCGPQIPKERLRRLGEIQNIKDLNLKDDKLITDSFVFLNHDDDDNANITSNSREDQRYGNANGNDNKKANSDTSDGTSTFRDHDEEEQEATDEDENQQIQLNSKTLSTQVNAMTNVFNILSSQTNIDFPICQDCCNILINRLKSEYDDAIKERDTYAQFLSKLESQNKEISESNKEKQYSHNLSEKENLKKEEERLLDQLLRLEMTDDDLDGELVRLQEKKVQLENEKLQKLSDQNLMDLNNIQFNKNLQSLKLQYELSLNQLDKLRKINIFNATFKISHSGPFATINGLRLGSIPESVVPWKEINAALGQLILLLATINKNLKINLVDYELQPMGSFSKIKKRMVNSVEYNNSTTNAPGDWLILPVYYDENFNLGRIFRKETKFDKSLETTLEIISEITRQLSTIASSYSSQTLTTSQDESSMNNANDVENSTSILELPYIMNKDKINGLSVKLHGSSPNLEWTTAMKFLLTNVKWLLAFSSNLLSKSITLSPTVNYNDKTISGN

SEQ ID NO: 322 - protein, 393 aa, Homo sapiens; identical to SEQ ID NO: 194

SEQ ID NO: 323 - protein, 698 aa, Mus musculus
MGDPGLAKLQFAPFNSALDVGFWHELTQKKLNEYRLDEAPKDIKGYYYNGDSAGLPTRLTLEFSAFDMSASTPAHCCPAMGTLHNTNTLEAFKTADKKLLLEQSANEIWEAIKSGAALENPMLLNKFLLLTFADLKKYHFYYWFCCPALCLPESIPLIRGPVSLDQRLSPKQIQALEHAYDDLCRAEGVTALPYFLFKYDDDTVLVSLLKHYSDFFQGQRTKITVGVYDPCNLAQYPGWPLRNFLVLAAHRWSGSFQSVEVLCFRDRTMQGARDVTHSIIFEVKLPEMAFSPDCPKAVGWEKNQKGGMGPRMVNLSGCMDPKRLAESSVDLNLKLMCWRLVPTLDLDKVVSVKCLLLGAGTLGCNVARTLMGWGVRHVTFVDNAKISYSNPVRQPLYEFEDCLGGGKPKALAAAERLQKIFPGVNARGFNMSIPMPGHPVNFSDVTMEQARRDVEQLEQLIDNHDVIFLLMDTRESRWLPTVIAASKRKLVINAALGFDTFVVMRHGLKKPKQQGAGDLCPSHLVAPADLGSSLFANIPGYKLGCYFCNDVVAPGDSTRDRTLDQQCTVSRPGLAVIAGALAVELMVSVLQHPEGGYAIASSSDDRMNEPPTSLGLVPHQIRGFLSRFDNVLPVSLAFDKCTACSPKVLDQYEREGFTFLAKVFNSSHSFLEDLTGLTLLHQETQAAEIWDMSDEETV

SEQ ID NO: 324 - protein, 607 aa, Homo sapiens; identical to SEQ ID NO: 204

SEQ ID NO: 325 - protein, 220 aa, Homo sapiens; identical to SEQ ID NO: 202

SEQ ID NO: 326 - protein, 121 aa, Homo sapiens; identical to SEQ ID NO: 274

SEQ ID NO: 327 - protein, 458 aa, Homo sapiens; identical to SEQ ID NO: 195

SEQ ID NO: 328 - protein, 474 aa, Homo sapiens; identical to SEQ ID NO: 196

SEQ ID NO: 329 - protein, 477 aa, Arabidopsis thaliana
MKAICDRFVPSKCSSSSTSEKRDISSPTSLVSDSASSDNKSNLTLCSDVVASSSPVSQLCREASTSGHNPVCTTHSSWTVILKTASMASGAIRRFQDRVLGPSRTGISSSTSEIWLLGVCYKISEGESSEEADAGRVLAAFRQDFSSLILMTYRRGFEPIGDTTYTSDVNWGCMLRSGQMLFAQALLFQRLGRSWRKKDSEPADEKYLEILELFGDTEASAFSIHNLILAGESYGLAAGSWVGPYAVCRSWESLARKNKEETDDKHKSFSMAVHIVSGSEDGERGGAPILCIEDVTKTCLEFSEGETEWPPILLLVPLVLGLDRVNPRYIPSLIATFTFPQSLGILGGKPGASTYIVGVQEDKGFYLDPHDVQQVVTVKKENQDVDTSSYHCNTLRYVPLESLDPSLALGFYCQHKDDFDDFCIRATKLAGDSNGAPLFTVTQSHRRNDCGIAETSSSTETSTEISGEEHEDDWQLL

SEQ ID NO: 330 - protein, 337 aa, Arabidopsis thaliana
MAKEAVKYVWEGAIPLQIHLHKSDVASHPAPPPALVLAPRIGYLPLLIPLIKPYFKDSLPPGEDSIWFDYKGFPLKWYIPTGVLFDLLCAEPERPWNLTIHFRGYPCNILIPCEGEDSVKWNFVNSLKEAQYIINGNCKNVMNMSQSDQEDLWTSVMNGDLDAYTRLSPKLKMGTVEDEFSRKTSLSSPQSQQVVPETEVAGQVKTARIPVRLYVRSLNKDFENLEDVPEIDTWDDISYLNRPVEFLKEEGKCFTLRDAIKSLLPEFMGDRAQTSGEERSIDDTEEADGSREMGEIKLVRIQGIEMKLEIPFSWVVNNLMNPEFYLHISVLVKAPQR

SEQ ID NO: 331 - protein, 509 aa, Arabidopsis thaliana
MVQEEKAMEAINDALRALRKRHLLEEGAHAPAISALSKPLISQGSEWKEKTEKLETELQQCYKAQSRLSEQLVIEVAESRTSKAILQEKELLINDLQKELTQRREDCTRLQEELEEKTKTVDVLIAENLEIRSQLEEMTSRVQKAETENKMLIDRWMLQKMQDAERLNEANDLYEEMLAKLKANGLETLARQQVDGIVRRNEDGTDHFVESTIPSTCANRIHAHEGGCGSIVFEYNSGTLFTGGQDRAVKMWDTNSGTLIKSLYGSLGNILDMAVTHDNKSVIAATSSNNLFVWDVSSGRVRHTLTGHTDKVCAVDVSKFSSRHVVSAAYDRTIKLWDLHKGYCTNTVLFTSNCNAICLSIDGLTVFSGHMDGNLRLWDIQTGKLLSEVAGHSSAVTSVSLSRNGNRILTSGRDNVHNVFDTRTLEICGTLRASGNRLASNWSRSCISPDDDYVAAGSADGSVHVWSLSKGNIVSILKEQTSPILCCSWSGIGKPLASADKNGYVCTWT

SEQ ID NO: 332 - protein, 398 aa, Homo sapiens; identical to SEQ ID NO: 193

SEQ ID NO: 333 - protein, 273 aa, Caenorhabditis elegans
MDYEVCRKVWESHVPCQFTLQSSGGTHGEPLPFYTMLPRFSYLALAIQKVLSSFNRRDDGEKVHSDKMWLEHNGIPLKMYIPIGVIYDQANLSENDSILEIIVRTSQPPPQFQMVDRDMMEAMFMQNIKEADYLKTKAEITKNMMKDESAQLWRSVCNNNFDEFWTIVQKLMETSEGNEFAHIPLRVYVKNQAFKQALITAKHPDGSLRTIGEAVSDVLSSSSSSSTDSQSEHPPRLISHGIDIPHHTPLIFAAKNLSYPDNFIHVVLLLVVP

SEQ ID NO: 334 - protein, 305 aa, Caenorhabditis elegans
MQNLVNNLKSAALQIGETFTPVLRESKFRETGVLTPEEYVAAGDHLVHHCPTWKWAGASDPSKIRTFLPIDKQFLITRNVPCHKRCKQMEYDEKLEKIINEEDGEYQTSDETGWVDTHHYEKEHEKNEEKEQSTAPPPAAPEDSDDDDEEPLDLDELGLDDDEEDPNRFVVEKKPLAAGNDNSGEVEKVRTYDLHICYDKYYQVPRLFLMGYDENRRPLTVEQTYEDFSADHSNKTITVEAHPSVDLTMPTVHPCKHAEMMKRLINQYAESGKVLGVHEYLFLFLKFVQAVIPTIEYDYTRAIKL

SEQ ID NO: 335 - protein, 375 aa, Caenorhabditis elegans
MTTQRSHICLNCQHPLRLDFTQRRPDSADSEKKSETVITEALTGHSRNLMKLISDAQFPSDAPVCNDCSDALRNEMDAQVATLDDEIKTYQTYINYLKENHPTTSIPDLKAKLQNVSDEEKELEQQLKKLLAEEEQLDLDLQTKRRTAEAASEKSGELWKKYRDNLRQVFEDQDELHSLEAERQYAEVQHRKLTDTNVLDLCFHIWVDGIVGEINGFRLGYLKDAPVEFTEINAALGQIVLLLEILLERIGVQHHELMPVAMGSHSYIKLRRNGIDMETYALYGQGTPLSGSSGIDPGIRRFLQLLEFLLKELKDRNKNFKPPYQIHADSLVDNGVKYNAVMTLNTDVRWTRAMALMLTDLKAACAQCDALRSPI

SEQ ID NO: 336 - protein, 130 aa, Caenorhabditis elegans
MSGNRGGSYISGIVPSFKERRPFHERQKDVEEIRSQQPNKVPVIIERFDGERSLPLMDRCKFLVPEHITVAELMSIVRRRLQLHPQQAFFLLVNERSMVSNSMSMSNLYSQERDPDGFVYMVYTSQPAFG

SEQ ID NO: 337 - protein, 521 aa, Caenorhabditis elegans
MNNIPDDFKKIASSSRLPRKYCSSESSLSDDDGHEIEHVLKHGAPEEALTPDTERMVVLGQDVVQSAPASLVPGGNLSWMSKIKSAGASMMGSIRPSSSSQDVHSTGEIEKHSKKKWKARLWSTWNNIKYSSTWMSDRSDEYGGENDVVFLGRRYSTSVDESGLRSGFENFCSDYYSRLWITYRTDFPALLDTDTTTDCGWGCMIRTTQMMVAQAIMVNRFGRDWRFTRRKRSHVAAHGDEDDFDREKIQEWMILKLFEDKPTAPLGIHKMVGIAAMGKGKKAVGSWYSPSEAVFIMKKALTESSSPLTGNTAMLLSIDGRVHIRDIEVETKNWMKKLILVIVVRLGAAELNPIYVPHLMRLFAMESCLGITGGRPDHSSWFVGYYGDQIIYLDPHVAHEYIPIDINPNTNVVDSDSKKAKKCPEKSYHCRLLSKMHFFDMDPSCALCFQFESREQFDNDMRQLNLSQFIDIDQGEEHGMKRVRDPMFSVVYGERRQPPSYEREVSETEQAQADKHGFEML

SEQ ID NO: 338 - protein, 578 aa, Caenorhabditis elegans
MQTRSIDNVVNWSRCVHPSCVAWVIFIHFCFAKNCSILYFVLFQFTFFAELMADSYRKLIIERLEDVKQRNKQTATLYNNYSKLAEQLEKKHKYGTSSSNSSQLETGELARVKEEMAELYRSKCQNDQRLIDANHRIADFEKKSSAIIAEKIALEATAKSICAKYAKTEVELQRLKVDNDQLNDERIASNTTVTMLTKQIQDIENDRIHFLNKIRELNEQRVDFLNAEVALEEKRRNSRIQDMITSAVQDITDKDTKLEEMLRAMPDTNSNGDLLLGDSVPSRAEFVLECEEGEVNDVHWLDGETFATGGSDRNIKIWKVDGHGGYTRIGTLAGSNAAFTRIDYERDRKHFIASSNDKNVRIWNLDNSRLLSTLSGHSDQVTCVKFYQSHSAVSGSADRVIKIWDIQNQRCSRSLFPASKVLDVATNMGASPSLFASGHFDKKLRFYDGRSTDPVRTVDMGGRITSLDVTMSGCELLVSTRDDTISLIDLRTFQTVHCYSAENYRTSSDLSRVVLSSGNEYVAAGSSNGSIFVWNRNSTKLEKQLCSNSENAIFSLSWNPTGYGLLSSSKQKFVTLWK

SEQ ID NO: 339 - protein, 517 aa, Arabidopsis thaliana
MRKEEIPDKSRTIPIDPNLPKWVCQNCHHSLTIVGVDSYAGKFFNDPPPSATQGSSIHGANSVLGSTRMDNSFVVLPRHKPPQSQGIPPRPRGASSPQPDATQSGKAMEESFVVVYKSEPVSDSGGSHNLSLEVGQNGPLHSNTSGFNATINVLTRAFDIARTQTQVEQPLCLECMRVLSDKLEKEVEDVTRDVEAYEACVQRLEGETQDVLSEADFLKEKKKIEEEERKLVAAIEETEKQNAEVNHQLKELEFKGNRFNELEDRYWQEFNNFQFQLIAHQEERDAILAKIEVSQAHLELLNKTNVLIDAFPIRNDGEFGTINNFRLGRLPAIKVEWDEINAAWGQACLLLHTMCNYFRPKFQCQVKIQPMGSYPRIVDSNNETYELFGPVNLFWSTRYDKAMTLYLMCLKDFADFANSKDQENNIPPDNCLNLPYKIEKDKVLGYSITQSFNKQESWTKALKYTLCNLKWALYWFVGNTNFQPLSATVSLPSNISAAGSLYAKRGPDSSKPSCKKT

SEQ ID NO: 340 - protein, 697 aa, Arabidopsis thaliana
MAEKETPAIILQFAPLNSSVDEGFWHSFSSLKLDKLGIDDSPISITGFYGPCGHPQVSNHLTLLSESLPLDEQSLIASTSHGNRNKCPVPGILYNTNTVESFNKLDKQSLLKAEANKIWEDIQSGKALEDPSVLPRFLVISFADLKKWSFRYWFAFPAFVLDPPVSLIELKPASEYFSSEEAESVSAACNDWRDSDLTTDVPFFLVSVSSDSKASIRHLKDLEACQGDHQKLLFGFYDPCHLPSNPGWPLRNYLALIRSRWNLETVWFFCYRESRGFADLNLSLVGQASITLSSGESAETVPNSVGWELNKGKRVPRSISLANSMDPTRLAVSAVDLNLKLMRWRALPSLNLNVLSSVKCLLLGAGTLGCQVARTLMGWGIRNITFVDYGKVAMSNPVRQSLYNFEDCLGRGEFKAVAAVKSLKQIFPAMETSGVVMAIPMPGHPISSQEEDSVLGDCKRLSELIESHDAVFLLTDTRESRWLPSLLCANANKIAINAALGFDSYMVMRHGAGPTSLSDDMQNLDINKTNTQRLGCYFCNDVVAPQDSMTDRTLDQQCTVTRPGLAPIAGALAVELLVGVLQHPLGINAKGDNSSLSNTGNNDDSPLGILPHQIRGSVSQFSQITLLGQASNSCTACSETVISEYRERGNSFILEAINHPTYLEDLTGLTELKKAANSFNLDWEDDDTDDDDVAVDL

SEQ ID NO: 341 - protein, 313 aa, Arabidopsis thaliana
MVLSQKLHEAFKGTVERITGPRTISAFKEKGVLSVSEFVLAGDNLVSKCPTWSWESGDASKRKPYLPSDKQFLITRNVPCLRRAASVAEDYEAAGGEVLVDDEDNDGWLATHGKPKDKGKEEDNLPSMDALDINEKNTIQSIPTYFGGEEDDDIPDMEEFDEADNVVENDPATLQSTYLVAHEPDDDNILRTRTYDLSITYDKYYQTPRVWLTGYDESRMLLQPELVMEDVSQDHARKTVTIEDHPHLPGKHASVHPCRHGAVMKKIIDVLMSRGVEPEVDKYLFLFLKFMASVIPTIEYDYTMDFDLGSSST

SEQ ID NO: 342 - protein, 269 aa, Drosophila melanogaster
MAHDREVLRMIWEGQIGICFQADRDEIVGIKPEPFYLMISRLSYLPLVTDKVRKYFSRYISAEHQDGAVWFDFNGTPLRLHYPIGVLYDLLHPEEDSTPWCLTIHFSKFPEDMLVKLNSKELLESHYMSCLKEADVLKHRGLVISAMQKKDHNQLWLGLVNEKFDQFWAVNRRLMEPYGDLESFKNIPLRIYTDDDFTYTQKLISPISVGGQKKSLADLMAELSTPVRRAVGCRTHGIDLHEETQLQWMSEHLSYPDNFLHLSVDYKDV

SEQ ID NO: 343 - protein, 649 aa, Schizosaccharomyces pombe
  misc_feature: 972h-
MFVGKALQFQSFHSSIDATFWHQLSNYKVEKQKLDASPLTIHGKFNTYSRGNISIVFGEAPSNSNIKDCLAEGTLLNANTPQEFTNADVKKIREEIGEVLLNSIKNGVVSERPNELLRFLIFSYADIKAYKYHYWCLFPSFKETPHWIVKDLSPAESLIPSGPILSQIREFLSTADYYQRPFFLLIKSTLDEWTIAPLKELSHCVDKSLQFYLVAEDSVQLAEYPSWPVRNILAFAFIKFKLKVINLFLYRDGINSDTLSKSILIKVEADKDMILEAPLSIVGWERNGKGVLGPRVVNLSTVLDPFVLSESASTLNLSLMRWRLVPQLDLDRIQNSKCLLLGAGTLGCGVARNLLSWGVRHVTFVDYSTVSYSNPVRQSLFTFEDCKRKLPKAECAAQRLKEIYPNMFSTGYNISIPMLGHPIYEAGIEKTMHDYETLENLISTHDAIFLLTDTRESRWLPTVISTAMDKLLINSALGFDSWLVMRHGSVLQKENRLGCYFCNDIFAPSNSLVDRTLDQTCTVTRSGCANIATAIAVELFVSLLQHPNGHAAPVLNEDQTVLGELPHQIRGFLHNFSLMKISGMAYPQCSACSECIINEWNREKWMFVLRAINEPDYVEELCGLREVQALGEIAGTMEEWISDKESVIL

SEQ ID NO: 344 - protein, 702 aa, Schizosaccharomyces pombe
MFYQPAQNKKQYDDLADIEAQNNVPNTQEVLEAWQESLDSDEDESSPLEESNGFTISEHDDFVKSVPRKNNPTDLLYSGKLLDSDEPPSVHGNSSKVPSKHPSPSFPETTSLRNLQNGSKQKPALPNFNDPHFYNEDVTRSGHPNRSIYTQLPRNEFSNARVLWNRLSARDRVLWRWANVENLDSFLQQVYTYYTGKGLSCIIVHRLFQILTVSFVIGFTTFITSCIDWPAVTPHGSLAGVTKSQCIAQMSPITYLVLWLFLSFLLALWIYYLTDIPRLWQMREFYIHALKIATADMPTVSWQRVLYRLLKLKNVNALTAEDGRVVSLHNMKRLDAYAIANRIMRKDNYFIALINNGIINIELPLLHRRILTHTTEWNINWCIFNFVFDEQGQLRSAFRNPNSRKRLSEELRRRFIVAGFLNCLFAPIVAIYLVIHNFFRYFNEYHKNPGALSTRRYTPLALWTFREYNELQHFFDERINDSYAAASHYVSQFPDFNMIRLFKYISFILGSFTAILVIITVFDPELMVTFEITKDRSVLFYLGLFGSLIAVSRSIIPDETLVFAPEKALRRVITFTHYMPGWWSDNMHSKAVQQEFCSLYSYRIVNLLWEILGILLTPVLLFFTFPSCSQDIVDFFREHTINVEGVGYVCSYAVFQDNPPYESVASLVQSRKISPLIQNKPELSRISFYEQFNTEAPRRDLR

SEQ ID NO: 345 - protein, 411 aa, Drosophila melanogaster
MLVGLSDQLARIMESVFEAYLGPDSVLASAVGQAVGSGEPEDIPRRNTDVWVLGKKYNAIQELELIRRDIQSRLWCTYRHGFSPLGEVQLTTDKGWGCMLRCGQMVLAQALIDLHLGRDWFWTPDCRDATYLKIVNRFEDVRNSFYSIHQIAQMGESQNKAVGEWLGPNTVAQILKKLVRFDDWSSLAIHVAMDSTVVLDDVYASCREGGSWKPLLLIIPLRLGITDINPLYVPALKRCLELDSSCGMIGGRPNQALYFLGYVDDEVLYLDPHTTQRTGAVAQKTAAAEQDYDETYHQKHAARLNFSAMDPSLAVCFLCKTSDSFESLLTKLKEEVLSLCSPALFEISQTRAVDWDTTEDIDWPTMPDIDWPAGTSDSDSFAIVEESGRDSDAGCSGAIGSGKKPSERAVI

SEQ ID NO: 346 - protein, 684 aa, Drosophila melanogaster
MSTEKEIILQFAPWESFVSPTFWHKLAELKLDHDRLSDSKRSITGHYTNRNASGCLLEVDYTAYNRMAKPPKFSHSAIGTIYNKNTIEEFKALDKLQLLADEGKELLADMCSGGALRDPSLLTRFFVLSFADLKCHSYYYWFAFPCPLTPTLKLQGAVQKLRDLPNSSSYIMALKALPTESQNFFILYANVEKNIFEARSLSSLDDKNVEFCYFGFADPSEYEHPAWIMRNYAAFLLQQCPSFVGKPLKFLGLRHNQQMNIDDSLVWKVIQTEACDLSQSENIKFVGWELNKNGKMGPRMVCMRDSMDPAKLAENSVNLNLKLMKWRLVPDLNLEIISQTKCLLFGAGTLGCAVARNLLSWGFKHITLLDSGKVGFSNPVRQNLYTHADAVAGNRMKATTAAQRLKEINPSAETAGYVLEIPMPGHTIGESLLAQTKEHLKVIEKLVQDHDVIFLLTDSRESRWLPTLLGAAKEKIVINAALGFDSYLVMRHGTTRKEAGDDGQEIEGLKCINGDQLGCYFCNDVTAPGNSLKDRTLDQQCTVTRPGVSNIAASYAVELLVALLQHPRKELAPAYYAQSGRGRSEETEEKVPEGLLGILPHSIRGMLCNYENILPATQKFAQCIACSAAVLNEYKKEGHAFLFKTFETAKFLEDLTGISEFKRLNSEIIDFDDEEFDMSDSDED

SEQ ID NO: 347 - protein, 422 aa, Drosophila melanogaster
MSEAEKQAVSFACQRCLQPIVLDEQLEKISVHAMAELSLPIYGDNGNTLDPQDASSFDHFVPPYRLTDSINGTGFMLVSDGRDNKKMSAAFKLKAELFDCLSSNSEIDHPLCEECADSMLEIMDRELRIAEDEWDVYKAYLDELEQQRVAPNVEALDKELDELKRSEQQLLSELKELKKEEQSLNDAIAEEEQEREELHEQEESYWREYTKHRRELMLTEDDKRSLECQIAYSKQQLDKLRDTNIFNITFHIWHAGHFGTINNFRLGRLPSVSVDWSEINAAWGQTVLLLSALARKIGLTFERYRVVPFGNHSYVEVLGENRELPLYGSGGFKFFWDTKFDAAMVAFLDCLTQFQKEVEKRDTEFLLPYKMEKGKIIDPSTGNSYSIKIQFNSEEQWTKALKFMLTNLKWGLAWVSSQFVSP

SEQ ID NO: 348 - protein, 604 aa, Drosophila melanogaster
MSTEEHVWRAHVVRRLRERNRKECDNFKEIIEQNNRLIDHVAQLKADNLKISVENEQLRNAVSTGGTGSNVAIATLEKKLLSQQEELTELHKRKGENSQMIVDLNQKVEQQRIIISEKEHSLVEQQTNNNRLRAEVQLLHSSLEELKKLNNTMLDEHTALQLAFSSLEEKLRGVQDENRRLLERLMQYKSKDADKLNEENESIIRKRSAKLKRDLEDAVREPSSSSNAASSPGAASLQRNSSPAQFVGGLIGDEDFDEAAINGAMEAIGLDDNEYISARFTAGEIAENSRASIDTLKATGYLGQANPTKILMKFEAHENESHAVRWSPVERMVATGGADRKVKLWDIGKNSTEPRAVLSGSSAGINSVDFDSTGAYILGTSNDYGARVWTVMDNRLRHTLTGHSGKVMAAKYVQEPIKVVTGSHDRTLKIWDLRSIACIETKFAGSSCNDLVTTDSLGSTIISGHYDKKIRFWDIRTEKQADDVLMPAKITSLDLSKDCNYLICSVRDDTIKLLDLRKNQVISTFTNEHFKISCDFARASFNSSGLKIACGSADGAIYIWNVNGFLEATLKGHSTAVNAVSWSPNNNMLASVGKNKRCTIYSES

SEQ ID NO: 349 - protein, 467 aa, Arabidopsis thaliana
MKALCDRFVPQQCSSSSKSDTHDKSPLVSDSGPSDNKSKFTLWSNVFTSSSSVSQPYRESSTSGHKQVCTTRNGWTAFVKRVSMASGAIRRFQERVLGPNRTGLPSTTSDVWLLGVCYKISADENSGETDTGTVLAALQLDFSSKILMTYRKGFEPFRDTTYTSDVNWGCMIRSSQMLFAQALLFHRLGRAWTKKSELPEQEYLETLEPFGDSEPSAFSIHNLIIAGASYGLAAGSWVGPYAICRAWESLACKKRKQTDSKNQTLPMAVHIVSGSEDGERGGAPILCIEDATKSCLEFSKGQSEWTPIILLVPLVLGLDSVNPRYIPSLVATFTFPQSVGILGGKPGASTYIVGVQEDKGFYLDPHEVQQVVTVNKETPDVDTSSYHCNVLRYVPLESLDPSLALGFYCRDKDDFDDFCLRALKLAEESNGAPLFTVTQTHTAINQSNYGFADDDSEDEREDDWQML

SEQ ID NO: 350 - protein, 226 aa, Arabidopsis thaliana
MDSAREVSDGRLTVEGFSVASRAFADKWKIHNQSFPPWSWVPLINRTLLVSKKQEEGYLSLEKIIILSSLEEEIPEDESLNVATDCLEKEETVDHTILVPTMENEAHYYDFHIVYSASYKVPVLYFRGYCSGGEPLALDVIKKDVPSCSVSLLLESKWTFITQEEHPYLNRPWFKLHPCGTEDWIKLLSQSSSSSGCQMPIVLYLVSWFSVVGQVVGLRIPLEMLN

SEQ ID NO: 351 - protein, 128 aa, Danio rerio
MPPFEKTPHPKPFKQRKSLATRKQEVAGIRTKFPTKIPVIIERYQREKFLPPLDKTKFLVPQELTMTQFVTIIRNRMTLMPNQAFYLLINNSGIASMSMTMAQLYKDHKDEDGFLYMTYASQEMFGHR

SEQ ID NO: 352 - protein, 625 aa, Ashbya gossypii
  misc_feature: ATCC 10895
MSQSLKFAPPFQSFVDASFFQVFSRLKLDVLRLDSHELPLHAKVDLAGLARGSSISHVFLDSQSFDEATASLPGISLRGSFFNFNTLEEFKRLDKGRFLSEQAQLLWEAGVNGYLDEAAGFFVICFADLKKYRFYYWFATPCFQPETLELKVVKREALTEIDKFSNFIEQNKILCGVLNEETGEVIRASRHELERYSTLVVRDTSNIEHCPTSLVKNFVAVWRHHNPNRSECRVLLLRETCSFSLELSVTGDAMSTSQLKASGWERNVRGLLTPKISELGAIIDPTKLAEQSIDLNLKLMKWRLVPDINLDIVKNCKVLLLGAGTLGCYVARSLLAWGVRKITFVDNGSVSYSNPVRQPLFNFTDCGQPKATSAAAAMKAIFPLVDATGFQLEVPMIGHPLTDEARQKKDYEELRQLIRDHDIVFLLMDSRETRWLPTILGNLESKLVINAALGFDSYLVMRHGNYEQPESSRLGCYFCHDVVAPSDSLTDRTLDEMCTVTRPGVALIAAAYATELAVSVLQHPQGNNAPETSESVLGSVPHQLRGFLPQLSTVKLRTPAYKHCSACSSVIVDAVRENGWEFLREALVDHRIVERLSGLAQVQQETETFLATMEISDDDCFDEIS

SEQ ID NO: 353 - protein, 405 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLGESCQVQVGSLGDSSDVERLERFFDSEDEDFEILSL

SEQ ID NO: 354 - protein, 122 aa, Pan troglodytes
MEIFIVKRVWEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVYASQETFGMKLSV

SEQ ID NO: 355 - protein, 485 aa, Danio rerio
MNSVSPSAVQYIVGGGAHEDKASASSKRHLGHGAVPDGIREGSGEPDEVDRLKAKFMSAWNNVKYGWTVKSKTSFNKSSPLILLGQSFLFNNEGEVERFRQTFVSCVWLTYRREFPQLDGSSLTTDCGWGCMLRSGQMMLAQGLLLHLMPTDWRWSDCHALTDVDFEVLKPRSPSRPAGMSMPSFSSSWSSSIPQINPSPGITEAHRRAPARCPSASPDPQVDALHRKVVSCFGDHPSAPFGVHQLVELGKESGKRAGDWYGPSVVAHMLRKAVARAAEFEDLAVYVAQDCTVYKEDVMSLCESSGVGWKSVVILVPVRLGGESLNPSYIECVKNILKLKCCIGIIGGKPKHSLFFVGFQDEQLLYLDPHYCQPVVDVTQANFSLESFHCNSPRKMNFSRMDPSCTIGLYARSKTDFESLCTAVSEALSSSKEKYPIFTFVEGRGQIYGMEGPSGGSVDAPAHIFTCSRLSRNNKRGSTDEFVLL

SEQ ID NO: 356 - protein, 688 aa, Danio rerio
MAHFDTEYQRLEASYSDSPPGEENLLVHVPEGSKSPWHHIENLDLFFQRISFNGFTCMLLGEIFELVQLVFVVAFTVFLANCVDYDILFANKFVNHTDSLKVTLPDAFLPVDVCSARIRDSVPVIFILVISGVFWLHRLVKFIYNICCYWEIRSFYINALKISMADLPYFTWQEVQARIVEIQKEHQICIHKKELSELDIYHRILRFKNYMVAMVNKSLLPVRFRLPVLGDTVFYTRGLKYNFELIFFWGPGSLFENEWSLKSEYKRGGNRLELADRLSSRILWIGIANLLLCPVILIWQILYAFFSYTEVIKREPGSLGARCWSLYGRFYLRHFNELDHELMSRLSKGYKASSKYMNCFMSPLLTVVAKNVAFFAGSILAVLIALTIYDEDVLAVEHVLSSITLLGVCITVCRSFIPDKHMVFCPEQLLKVILAHIHYMPDHWQGNAHRYETRDEFAQLFQYKAVSHGVFILEELLSPVITPFILIFCLRRKSLEIIDFFRNFTVDVVGVGDTCSFAQMDVRQHGHPAWMSAGKTEASIYQQAEDGKTELSLMHFAITNPHWQPPRESTHFISLLKEKVHRDAAVGQQGIIAENAGFTSTHSLHNDSEPRSLIANLLMGPPSLASLHLGREGSINHVSIGVSEGASALRSLSPVSTSLHLRGSYPSARLPRSDHPAVVAGRGMAGSG

SEQ ID NO: 357 - protein, 125 aa, Anopheles gambiae str. PEST
MAEEAEATGIDNNSEKDLATNVENLSLTNQKVEKQESKKIDIVLHATGSAPILKQKKWAVDQEKPISAIVKFIHKYLKLDAEERLFLYINQTFAPSPDQIIKNLYECYGTNGKLILHYAKTQAWG

SEQ ID NO: 358 - protein, 265 aa, Anopheles gambiae str. PEST
MANDREILREIWEGKIPVHFKLSADETDVEPEEYFLLIPRLSYFPLVTDKVRKHFLRFVSNELQDGEMWMDSNGTPLKWHFPIGVLYDLLVGTDGTLPWHVTVHFSKFPDDILIRCPNKEIVEAHFMSSLKEADVLKHRGQVVSAMQKKDHNQLWLGLVNDKFDQFWAVNRRLMEPIPDQDGFKHIPVRCYAEDGTYQQKLVAPSTASGQKRLLQDLLDDFSTPVRKAVEARTHGVTVPESTPLQWLSEHLSYPDNFLHLCLSYA

SEQ ID NO: 359 - protein, 424 aa, Anopheles gambiae str. PEST
MNDAKVSVSFSCQRCMQPIHVDDTFASLGEHTLAELALPINSHLEVDLESQSVSFDHFVPPFRVTDSTNDTNGFMLLSDGQNKESLGHSLRVKAELFDALSNNSEIDHPLCDECTDTLLELMDKQLKIAEDEWNDYNNYLKKLEMTDDVPNIDELEQELAGLKEDETRLLEELSSLSREEQSIRQAVEEQEKEKQRLEREENKYWREYTKHRRDVITTEDEFRSLECQMAYAQSQLEKLKKTNVFNATFHIWHSGHFGTINNFRLGRLPSAPVDWSEINAAWGQTCLLLSALARKMNFSFKQYRLVPYGNHSYIEVLGEGKELPLYGNGGFRFLWDSKYDAAMVAFLDCLQQFKEEIVRRDPDFCLPYLMEKGKIEDASTGSSFSIKIQFNSEEQWTKALKYLLTNLKWVLTWVSSQFTEDKQR

SEQ ID NO: 360 - protein, 223 aa, Anopheles gambiae str. PEST
KLLLICRLFSSFLPQHTLTGHSGKVLAAKFLGSAFLVTGSHDRTLKIWDLKNRSCTETKFAGSSCNDLVTTDSFSFISGHVDKKIRFWDVRTADCTANDIPLQGKITSLDLSKDGKFLLSCVRDDTINLLDLRQNRIVRTFRNDNFKVGCDWSRVAFSPSSSRIAAGSADGSVYIWNINGPLETVLKDPNGSGAAVTAVSWHPFSSTLASVDRAKKCTIWSNA

SEQ ID NO: 361 - protein, 389 aa, Anopheles gambiae str. PEST
GKMLDAYVGYDLSIATEPDDIPKTNDTVWILGKQYNASDDLEAIRQDVQSRLWCTYRRGFVPIGNTQLTTDKGWGCMLRCGQMVLAQALLQLHLGRDWVWEAETRDDIYLNIVNRFEDSKQAPFSLHQIALMGDSSEEKRIGEWFGPNTVAQVLKKLVKFDDWCRLVIHVALDNTVATDEIVELCVDKKEPEAWKPLLLIIPLRLGLSEVNPIYIEGLKKCFQLPGSCGMIGGRPNQALYFIGYVGGEALYLDPHTVQRVGTVGSKQDPAEQELDETFHQRYASRISFTSMDPSLAVCFLCVSRQQFDQLVARFNDSVNGGTSQALFEVTKTRQAPWTPTTASSASSRKNSGPTEAFNVISATEIPNEEFEEVEPRTLDDSDEEFEIIA

SEQ ID NO: 362 - protein, 302 aa, Anopheles gambiae str. PEST
AWGITHISIVDCGHISLSNPIRQSLYRYEDTLNGGKPKASTVAERLLEINPSAKITGINLKIPMPGHPVGQGNEVNETREILTKLINLIQQHDVIYLLTDSRESRWLPTMLGRFYNKIVMNAALGFDSYLVMRHGFQTNNIMEADGDTNLSSTVIAGFHKINCCDLGCYFCNDIVAPGNSMKDRTLDQQCTVTRPGVSNMASALAVELMISIIQHGDAPAYYRTPKSDPHAQQQEPEGLLGIIPHSIRGNISTLQSMVTATARYTNCVACSSLVLERYATSGQDFIINVLNGSESLEAIVGL

SEQ ID NO: 363 - protein, 699 aa, Neurospora crassa
  misc_feature: OR74A
MDLKFATFSSEIELPFYSALFSSKLDHDKLDSSARPVLGLYEPRSHASPEASTRMQILGSALTSDQDESGPLGMTRAEGYIKNVNTIEEFKNTDKNAMIKKAGEQIWDAIQDGTIYSCPSLLASFRILSYADLKKYKFTYWFAFPALHSEPQWKRTGPIGRLTSDESTALVERIGTWRYMVDRREHGFFLAKKVRREAAGPRSSLDDPGVDIGYRWDIGSLRDFETGFFNDAAEEDRYVAFVDPSNYPEYPSWPLRNLLILIRQRYRLNKVQILCYRDTQPRRHEARSTILPLAMDQVGDVELKCMPKVTGWERNGNGDLRPRVANLAEYMDPTRLADQAVDLNLKLMKWRLAPNLDLDAIKNTKCLLLGAGTLGSYVSRNLLGWGVRKITFIDYGSVSYSNPVRQPLFKFEDCHNGGKPKAIQAAEALKEIYPGVDVEGYALSVPMLDHAIHNEAKTKADFDKLKELIDSHDAIFLLMDTRESRWLPTLMGKAANKIVMNAALGFDTYVVMRHGAAPNDGSEETLGCYFCNDVVVAADSMKDQTLDQQCTVTRPGVAAIASALLVELLTSILQHPLKQHAPAPVSTGTGSAVSYERDPPDHPLGLVPHQVRGFLSNFQNMVIRGKSYPQCSACSKPILDAYKEGGWEFVKTALASRDYVAELSGLAEVQRLAEKAAAEMQWSEDEEGMDEEEGEGELI

SEQ ID NO: 364 - protein, 465 aa, Neurospora crassa
  misc_feature: OR74A
MFKRHAGPGRGGGGDGALRDNPAMSFVLLTESQIASSDALSLQKNNRSSAQDLSSGAYSSNNSNTNNNNVGASEEDDMANAHLSDQMERILKLFEVISARSDIDHPICIECSDMLVEEMQKKLESANREKDAYVNYLKELKASEPTDEEIRAQEEATRKAKQAEKELLEELKALEQEQAALEREKLELEAEIREVDIKEEEFWRARNGFNTTLIDFQNERDSINSKFDHDSRQLEKLQRSNVFNDTFCISHDGTFATINGLRLGRMHNVPVDWPEINAAWGHALLLLVTVAEKLNFRFEGYEPQPMGSTSRIVRIEPASTSMASSFYPSRPVDANAPPPPAKRTVLELYSSGDFPLGFTFIHRKFDTAMVAFLELVRQLGVHVQEQTRREGNPLSLPYQIQGDKISDVSIKLGVQQDDSWAKACKLTLTCCKFLLAHASNSWLHDYDFEAYEILDCILIGENSLG

SEQ ID NO: 365 - protein, 908 aa, Neurospora crassa
  misc_feature: OR74A
MADGVIARLMSGGRGARSFYEELRGRDNVSDVDDRAGLLDEENLNQHFNDYDLENAEGLRLEDSRATVDGRIPRGRAQLSGRPPRPAATTHWGTSHDDDGDNDVPASLLVERYDRGAAPLGSPGKPRSQHAGSRAHPAPGLSKGRTHQQRPHIDQELQPPLHSDAAPSSLLAGAITGNAKKMAEWRWANITNLDSFMQDVYSYYRGSGMWCIVVERVLHLIKVAFVAFLLTFLSQCVDFKKIPSNQKLSQVLVPQCTRNMSGLWNIGLWLFAFYFMWKSIQYILDLRRLTHVRDFYIHLLNIPDEDMQTITWQEVVARIMVLRDQNVRTTRTITPQNQRWVLGSQSKERLDASDIANRLMRRENYMIAMINKDILDLTIPLPILRNRQLLSQTLEWTLMFSILDFVFDPKGQVHQEFLRSDRRGILSAKLRSRFIFAGVMILILSPFVAGYLIIVYFLEYYNEIQKNPSILSARSYTPLAEWKFREFNELPHLFKRRLDMSHPFASHYIDQFPKAKTSMVAKTVSFIAGSIATVLALISVFDPEMFLGFEITHDRTVLFYTAVFGAIWSVARGSVSEDNAVFDPEYALGNVVEYTHYQPEHWKDRWHSADVKAEFEELYKLKLVIFIEEILSILTTPFVLFFSLPKSADQIIDFFREFTIHVDGLGYVCYFAEFDFKKGSKSQAPAATAGEGDVRDDYYSTKHGKMEASMYGFINNYARNPKHLPPAMRQQFHLPPVFPGITSPTLAGDLAASRMGRSQRGRSKGPLPSRTPRPGAVMAEPSPMASILLDPRHQPIFPNNMSFVNTGHQFRGGNQGDGHMMGGGSMEEDVKGAARHGQQTHDDESEDSRAGLDESAWQVSPTKDLSRENSGRGLDSVVGEEAGNGAGVVHMLYQFNQAHLNRRLGGVR

SEQ ID NO: 366 - protein, 502 aa, Magnaporthe grisea
  misc_feature: 70-15
MFCQKCRTPLKLDGSLDDLNPAAYDLLVTTSSQQQAHKDATSLSSPNPAHVHDQNRKAAYESAIKNAIGSPTFKRRSDITGLRGDKAMRDSSMSFILLEESQIAPSRHGAAGRSSGPASPNASKGSAATPAADDDSANETNRMLRLFEILSARSDIDHPVCVECTDILVEGLRKRLESASRERTTYVNFLKKLELESPTDDELKAQEEALAKAKEQEAAALKELVALEKEKASLDDEILALEEESRRMDAEEEQFWRERNAFASQLADFQNERDSINSKYDHDARLLQSLQRTNVYNDTFLISHDGTFATINGLRLGRLHNTPVDWPEINAAWGHALLLVATVADKLQYRFDGYEPQPMGSMSRIIRFEPPSPAASRVGSAPPQAPKKKVLELYSSGDMPLGLTFMHRKLDAAMVAYLELVRQLGMFMVRTTTANGKPLTLPYVIDGDKINGVSIKLGIAQDDAWTKACKFVLTCCKFLLAHASNISTMANGRGKVLGSSST

SEQ ID NO: 367 - protein, 917 aa, Magnaporthe grisea
  misc_feature: 70-15
MASNIFSRLVPQDRGRSFYEDLRQTDPDADLESRAGIDIDEENLNRSYHDYDLDEAERLAGDESHISHSRGDVAGANTVHRRGQKANTARWLGAGVEDDVDNDVPESLLVETPRAPQHLLLSPSRAGPSHPRPTAVPGPSTRQNQAQWEATRHQQRLHNDDTMPHGPFSGRAGQGRPEPPPVGLMAGDPYEQAMWRWVNVSNLDNFIKDVYAYYRAAGFWCIIVQRILELVNAAFVAVFLTFLSQCVDYHKLPHSKKMEDIIIPKCTQNMSLVWNVGLWLFAIYFICRCFGLIIQLRQLKHLRDFYTHLLKIPEADMQSVSWQDVVGRIMALRDSHPRTAGNLTRVQRAWIGSQSKERLDAHDIANRIMRRENFMIAMLNKDVLDLTIPLPFFRNKQHMSECVVLAISFSILDFVFDNQGQVNPEFLKASRRRQLSQKLKSRFFFAGLMIFVMSPFIALYLILVYFLTYFHEFRNDPGALGARTYNSLAKWKFREFNELDHLFNDRMNMSHPFAKRYIDMFPKRKTEQVARTVSFITGSIVAVLGLATIFDSEAFLTFEITPDRSVLFYVSILATLWAVARGNISDDNEVYDPEFAMKSIIEFTHYEPDHWRGRLHSTEVKNEFSELYKPRPQIFLEEILSILLTPLVLLVSLPNSTDQIVDFFREFTIHVDGLGYVCLFSVFNFQQGHANQKQAAAADAPDNREEYYSTKHGKMAASFYGFLDHYVINPKTGLPGNQLPGSRQQFQHPPSFPGLQSPTLAADMRHSRMMRERGRSSGVQIQGSQGRTPQFRTPMPQPSPMASILLDPHHQPAPGAFGSRSMHRSRQMAVPHRGGYMSDRDIIEEAVTEDGQDDARFGKLGDEDIDESGGALDESTWQTSPTKTLSRENSGANPQETEVGVLGLIHQFQQAHMHLRR

SEQ ID NO: 368 - protein, 714 aa, Magnaporthe grisea
  misc_feature: 70-15
MSGNDEAAAAGVAPPQTLQFAPFESQIEMPFYSALFSRKLDHDKLDDSVRPVIGLYQPMSERPPAESTRMQIQGGALSSSHVPMGYTRADGSIRNFNTIEDFKKADKGAILRQAGAQIWDAIKDGSIYEIPSLLSSFAILSYADLKKYRFTYWFAYPTLHSVPAWRRDGPLARFSSKETTALVNEVGTFRYAHDTRQHGFFLAKKVPYRSGPFRRGLPRDDSDGDDIGFTWSIGALGEFEKGFFKGIKEEDQYIAFVDSSSYAENPSWPLRNLLVLIRQRFQLQKANILCYRDTQARRDEPRSIVLPLASEGPATPQTSEMPKVTGWERHPSSKLQARVISLAEYMDPTRIADQAVDLNLKLMKWRISPKLDLEAMRSLKCLLLGAGTLGSYVSRNLMGWGVRKITFVDYGNVSFSNPVRQPLFEFEDCLSGGVPKAPKAAEALKKINPGVEAEGHVLSVPMLGHPVLNEAQTKEDFEKLQQLIKAHDVVFLLMDTRESRWLPTVMGKAEGKIVMNAALGFDTYVVMRHGAAPKDGTESTLGCYFCNDVVAPSDSMKDQTLDQQCTVTRPGVAAIASAMLVEMLTSVLQHPQREHAPAPKATGPPGNPEYQRDPPDHALGIVPHQVRGFLANFQNMIISGESYPNCSACSSPIVGAYKSDGWEFVKKALSDKDYVLELSGLAEVQRQAEAMQNEVDWDEDEDVAAAEEGDGEML

SEQ ID NO: 369 - protein, 121 aa, Gallus gallus
MPSDRAFKQRRTFADRCKEVQQIREQHPNKIPVIIERYKGEKQLPVLDKTKFLVPDHVNMSELVKIIRRRLQLNPTQAFFLLVNQHSMVSVSTPISEIYEQEKDEDGFLYMVYASQETFGY

SEQ ID NO: 370 - protein, 142 aa, Gallus gallus
MQAGPGVQAVRPFKLRKSLATRREEVAGIRAKFPTKIPVIVERYQKEKYLPLLDKTKFLVPEELTMTQFITIIRSRMALTATQAFYLLVNNKSLASMSLTMAEVYRDYKDEDGFVYMTYASQEMFGCCSLTLGKTMECHHKT

SEQ ID NO: 371 - protein, 227 aa, Gallus gallus
MSCSMAVEEDFFLEEKRFKQYCEEFVKHSQQIGDGWEWRTTKDLGDGYLSKTHFQVTNKSISPDLKKENGSTEQTLLTHVEESSDDSQVAGVCATEEVIRYEYHVLYSSSYQVPVLYFRACFLDGRPLTLDEIWKSVHVCYQARLQEGPWDTITQQEHPLLGQPFFVLHPCRTNEFMCSILAGSQKDNRHRNYIVLWLSTVGPVVGLTLPLSYAKLEPEENTNAEID

SEQ ID NO: 372 - protein, 461 aa, Kluyveromyces lactis
MTDLTLRCMHCHSMLEIDVSLMDLSMAQRDLLVSSDANTSGKDSSANSNQIPADKLKVMKEVKQPSQLRLTKPGNIASDSYVFLTDTEYSLQKSKIGGDESGDEEDYDDRNKTLSSRINALGNIFNILSSKNNVDYPVCQGCCDTLLEKLKEEYNQELKKRDTYHDFMKRIQEHKNVNGINIGDNRALEELSSLKKEKEQLLRELQRLEDEDEKLQKETILLQEELAKKKDQYIVRLQKQNIQELEQLTFIKDVQSLKNQRVVTLNHIDKLRKLNIYNETFRISHDGPFGTINDLKLGSVPNASVPWSEINSALGQVVLLLSLIAEKLSVSFTDYKLIPMGSTSSIEKFDPKTNQWFVHKAFSGDEFSFGSLFHKESAIDKALTCILEIISLLSAKVSSDSQDPASIELPYEILGDKINGLTILLNGATPSLEWTTSCKFLLTNVKWLLAFSTAHIDKNKP

SEQ ID NO: 373 - protein, 121 aa, Canis familiaris
MPSDRPFKQRRTFADRCKEVQQIRDQHPSKIPVIIERYKGEKQLPVLDKTKFLVPDHVNMSELVKIIRRRLQLNPTQAFFLLVNQHSMVSVSTPIADIYEQEKDDDGFLYMVYASQETFGF

SEQ ID NO: 374 - protein, 148 aa, Bos taurus
MQTPQKSPSLRPFKQRKSLATRREEVAGIRVKFPGKIPVIVERYPREKFLPRLDKTKFLVPQELTMTQFLSVIRSRMVLGATEAFYLLVNNKSLGSMNVTMAEIYRDYKDEDGFVYMTYASQEMFGCLGSAAPEDASSLGEDRPCHPL

SEQ ID NO: 375 - protein, 120 aa, Danio rerio
MSDNAESPTENPKDEHSLQHAVTDHSESSDEKKKIDVLLKAVGDTPIMKTKKWSVERRRTIQSLAQFISRFLKLEPSEQLFIYVNQSFAPSPDQEVGVLFECFGSDGKLVLHYCKSQAWG

SEQ ID NO: 376 - protein, 5 aa, Artificial Sequence
  Synthetic peptide
  misc_feature (5)..(5): Xaa is Tyrosine or Phosphotyrosine
EVAEX

SEQ ID NO: 377 - protein, 5 aa, Artificial Sequence
  Synthetic peptide
  misc_feature (4)..(4): Xaa is Tyrosine or Phosphotyrosine
VAEXL

SEQ ID NO: 378 - protein, 5 aa, Artificial Sequence
  Synthetic peptide
  misc_feature (3)..(3): Xaa is Tyrosine or Phosphotyrosine
AEXLT

SEQ ID NO: 379 - protein, 5 aa, Artificial Sequence
  Synthetic peptide
  misc_feature (2)..(2): Xaa is Tyrosine or Phosphotyrosine
EXLTP

SEQ ID NO: 380 - protein, 5 aa, Artificial Sequence
  Synthetic peptide
  misc_feature (1)..(1): Xaa is Tyrosine or Phosphotyrosine
XLTPV

SEQ ID NO: 381 - protein, 6 aa, Artificial Sequence
  Synthetic peptide
  misc_feature (6)..(6): Xaa is Tyrosine or Phosphotyrosine
LEVAEX

SEQ ID NO: 382 - protein, 6 aa, Artificial Sequence
  Synthetic peptide
  misc_feature (5)..(5): Xaa is Tyrosine or Phosphotyrosine
EVAEXL

SEQ ID NO: 383 - protein, 6 aa, Artificial Sequence
  Synthetic peptide
  misc_feature (4)..(4): Xaa is Tyrosine or Phosphotyrosine
VAEXLT

SEQ ID NO: 384 - protein, 6 aa, Artificial Sequence
  Synthetic peptide
  misc_feature (3)..(3): Xaa is Tyrosine or Phosphotyrosine
AEXLTP

SEQ ID NO: 385 - protein, 6 aa, Artificial Sequence
  Synthetic peptide
  misc_feature (2)..(2): Xaa is Tyrosine or Phosphotyrosine
EXLTPV

SEQ ID NO: 386 - protein, 6 aa, Artificial Sequence
  Synthetic peptide
  misc_feature (1)..(1): Xaa is Tyrosine or Phosphotyrosine
XLTPVL

SEQ ID NO: 387 - protein, 7 aa, Artificial Sequence
  Synthetic peptide
  misc_feature (6)..(6): Xaa is Tyrosine or Phosphotyrosine
LEVAEXL

SEQ ID NO: 388 - protein, 7 aa, Artificial Sequence
  Synthetic peptide
  misc_feature (5)..(5): Xaa is Tyrosine or Phosphotyrosine
EVAEXLT

SEQ ID NO: 389 - protein, 7 aa, Artificial Sequence
  Synthetic peptide
  misc_feature (4)..(4): Xaa is Tyrosine or Phosphotyrosine
VAEXLTP

SEQ ID NO: 390 - protein, 7 aa, Artificial Sequence
  Synthetic peptide
  misc_feature (3)..(3): Xaa is Tyrosine or Phosphotyrosine
AEXLTPV

SEQ ID NO: 391 - protein, 7 aa, Artificial Sequence
  Synthetic peptide
  misc_feature (2)..(2): Xaa is Tyrosine or Phosphotyrosine
EXLTPVL

SEQ ID NO: 392 - protein, 8 aa, Artificial Sequence
  Synthetic peptide
  misc_feature (6)..(6): Xaa is Tyrosine or Phosphotyrosine
LEVAEXLT

SEQ ID NO: 393 - protein, 8 aa, Artificial Sequence
  Synthetic peptide
  misc_feature (5)..(5): Xaa is Tyrosine or Phosphotyrosine
EVAEXLTP

SEQ ID NO: 394 - protein, 8 aa, Artificial Sequence
  Synthetic peptide
  misc_feature (4)..(4): Xaa is Tyrosine or Phosphotyrosine
VAEXLTPV

SEQ ID NO: 395 - protein, 8 aa, Artificial Sequence
  Synthetic peptide
  misc_feature (3)..(3): Xaa is Tyrosine or Phosphotyrosine
AEXLTPVL

SEQ ID NO: 396 - protein, 9 aa, Artificial Sequence
  Synthetic peptide
  misc_feature (6)..(6): Xaa is Tyrosine or Phosphotyrosine
LEVAEXLTP

SEQ ID NO: 397 - protein, 9 aa, Artificial Sequence
  Synthetic peptide
  misc_feature (5)..(5): Xaa is Tyrosine or Phosphotyrosine
EVAEXLTPV

SEQ ID NO: 398 - protein, 9 aa, Artificial Sequence
  Synthetic peptide
  misc_feature (4)..(4): Xaa is Tyrosine or Phosphotyrosine
VAEXLTPVL

SEQ ID NO: 399 - protein, 10 aa, Artificial Sequence
  Synthetic peptide
  misc_feature (6)..(6): Xaa is Tyrosine or Phosphotyrosine
LEVAEXLTPV

SEQ ID NO: 400 - protein, 10 aa, Artificial Sequence
  Synthetic peptide
  misc_feature (5)..(5): Xaa is Tyrosine or Phosphotyrosine
EVAEXLTPVL

SEQ ID NO: 401 - protein, 11 aa, Artificial Sequence
  Synthetic peptide
  misc_feature (6)..(6): Xaa is Tyrosine or Phosphotyrosine
LEVAEXLTPVL

SEQ ID NO: 402 - protein, 5 aa, Artificial Sequence
  Synthetic peptide
  misc_feature (5)..(5): Xaa is Tyrosine or Phosphotyrosine
DMEEX

SEQ ID NO: 403 - protein, 5 aa, Artificial Sequence
  Synthetic peptide
  misc_feature (4)..(4): Xaa is Tyrosine or Phosphotyrosine
MEEXE

SEQ ID NO: 404 - protein, 5 aa, Artificial Sequence
  Synthetic peptide
  misc_feature (3)..(3): Xaa is Tyrosine or Phosphotyrosine
EEXEE

SEQ ID NO: 405 - protein, 5 aa, Artificial Sequence
  Synthetic peptide
  misc_feature (2)..(2): Xaa is Tyrosine or Phosphotyrosine
EXEES

SEQ ID NO: 406 - protein, 5 aa, Artificial Sequence
  Synthetic peptide
  misc_feature (1)..(1): Xaa is Tyrosine or Phosphotyrosine
XEESG

SEQ ID NO: 407 - protein, 6 aa, Artificial Sequence
  Synthetic peptide
  misc_feature (6)..(6): Xaa is Tyrosine or Phosphotyrosine
ADMEEX

SEQ ID NO: 408 - protein, 6 aa, Artificial Sequence
  Synthetic peptide
  misc_feature (5)..(5): Xaa is Tyrosine or Phosphotyrosine
DMEEXE

SEQ ID NO: 409 - protein, 6 aa, Artificial Sequence
  Synthetic peptide
  misc_feature (4)..(4): Xaa is Tyrosine or Phosphotyrosine
MEEXEE

SEQ ID NO: 410 - protein, 6 aa, Artificial Sequence
  Synthetic peptide
  misc_feature (3)..(3): Xaa is Tyrosine or Phosphotyrosine
EEXEES

SEQ ID NO: 411 - protein, 6 aa, Artificial Sequence
  Synthetic peptide
  misc_feature (2)..(2): Xaa is Tyrosine or Phosphotyrosine
EXEESG

SEQ ID NO: 412 - protein, 6 aa, Artificial Sequence
  Synthetic peptide
  misc_feature (1)..(1): Xaa is Tyrosine or Phosphotyrosine
XEESGL

SEQ ID NO: 413 - protein, 7 aa, Artificial Sequence
  Synthetic peptide
  misc_feature (6)..(6): Xaa is Tyrosine or Phosphotyrosine
ADMEEXE

SEQ ID NO: 414 - protein, 7 aa, Artificial Sequence
  Synthetic peptide
  misc_feature (5)..(5): Xaa is Tyrosine or Phosphotyrosine
DMEEXEE

SEQ ID NO: 415 - protein, 7 aa, Artificial Sequence
  Synthetic peptide
  misc_feature (4)..(4): Xaa is Tyrosine or Phosphotyrosine
MEEXEES

SEQ ID NO: 416 - protein, 7 aa, Artificial Sequence
  Synthetic peptide
  misc_feature (3)..(3): Xaa is Tyrosine or Phosphotyrosine
EEXEESG

SEQ ID NO: 417 - protein, 7 aa, Artificial Sequence
  Synthetic peptide
  misc_feature (2)..(2): Xaa is Tyrosine or Phosphotyrosine
EXEESGL

SEQ ID NO: 418 - protein, 8 aa, Artificial Sequence
  Synthetic peptide
  misc_feature (6)..(6): Xaa is Tyrosine or Phosphotyrosine
ADMEEXEE

SEQ ID NO: 419 - protein, 8 aa, Artificial Sequence
  Synthetic peptide
  misc_feature (5)..(5): Xaa is Tyrosine or Phosphotyrosine
DMEEXEES

SEQ ID NO: 420 - protein, 8 aa, Artificial Sequence
  Synthetic peptide
  misc_feature (4)..(4): Xaa is Tyrosine or Phosphotyrosine
MEEXEESG

SEQ ID NO: 421 - protein, 8 aa, Artificial Sequence
  Synthetic peptide
  misc_feature (3)..(3): Xaa is Tyrosine or Phosphotyrosine
EEXEESGL

SEQ ID NO: 422 - protein, 9 aa, Artificial Sequence
  Synthetic peptide
  misc_feature (6)..(6): Xaa is Tyrosine or Phosphotyrosine
ADMEEXEES

SEQ ID NO: 423 - protein, 9 aa, Artificial Sequence
  Synthetic peptide
  misc_feature (5)..(5): Xaa is Tyrosine or Phosphotyrosine
DMEEXEESG

SEQ ID NO: 424 - protein, 9 aa, Artificial Sequence
  Synthetic peptide
  misc_feature (4)..(4): Xaa is Tyrosine or Phosphotyrosine
MEEXEESGL

SEQ ID NO: 425 - protein, 10 aa, Artificial Sequence
  Synthetic peptide
  misc_feature (6)..(6): Xaa is Tyrosine or Phosphotyrosine
ADMEEXEESG

SEQ ID NO: 426 - protein, 10 aa, Artificial Sequence
  Synthetic peptide
  misc_feature (5)..(5): Xaa is Tyrosine or Phosphotyrosine
DMEEXEESGL

SEQ ID NO: 427 - protein, 11 aa, Artificial Sequence
  Synthetic peptide
  misc_feature (6)..(6): Xaa is Tyrosine or Phosphotyrosine
ADMEEXEESGL

SEQ ID NO: 428 - protein, 5 aa, Artificial Sequence
  Synthetic peptide
  misc_feature (5)..(5): Xaa is Serine or Phosphoserine
ESVLX

SEQ ID NO: 429 - protein, 5 aa, Artificial Sequence
  Synthetic peptide
  misc_feature (4)..(4): Xaa is Serine or Phosphoserine
SVLXK

SEQ ID NO: 430 - protein, 5 aa, Artificial Sequence
  Synthetic peptide
  misc_feature (3)..(3): Xaa is Serine or Phosphoserine
VLXKY

SEQ ID NO: 431 - protein, 5 aa, Artificial Sequence
  Synthetic peptide
  misc_feature (2)..(2): Xaa is Serine or Phosphoserine
LXKYE

SEQ ID NO: 432 - protein, 5 aa, Artificial Sequence
  Synthetic peptide
  misc_feature (1)..(1): Xaa is Serine or Phosphoserine
XKYED

SEQ ID NO: 433 - protein, 6 aa, Artificial Sequence
  Synthetic peptide
  misc_feature (6)..(6): Xaa is Serine or Phosphoserine
MESVLX

SEQ ID NO: 434 - protein, 6 aa, Artificial Sequence
  Synthetic peptide
  misc_feature (5)..(5): Xaa is Serine or Phosphoserine
ESVLXK

SEQ ID NO: 435 - protein, 6 aa, Artificial Sequence
  Synthetic peptide
  misc_feature (4)..(4): Xaa is Serine or Phosphoserine
SVLXKY

SEQ ID NO: 436 - protein, 6 aa, Artificial Sequence
  Synthetic peptide
  misc_feature (3)..(3): Xaa is Serine or Phosphoserine
VLXKYE

SEQ ID NO: 437 - protein, 6 aa, Artificial Sequence
  Synthetic peptide
  misc_feature (2)..(2): Xaa is Serine or Phosphoserine
LXKYED

SEQ ID NO: 438 - protein, 6 aa, Artificial Sequence
  Synthetic peptide
  misc_feature (1)..(1): Xaa is Serine or Phosphoserine
XKYEDQ

SEQ ID NO: 439 - protein, 7 aa, Artificial Sequence
  Synthetic peptide
  misc_feature (6)..(6): Xaa is Serine or Phosphoserine
MESVLXK

SEQ ID NO: 440 - protein, 7 aa, Artificial Sequence
  Synthetic peptide
  misc_feature (5)..(5): Xaa is Serine or Phosphoserine
ESVLXKY

SEQ ID NO: 441 - protein, 7 aa, Artificial Sequence
  Synthetic peptide
  misc_feature (4)..(4): Xaa is Serine or Phosphoserine
SVLXKYE

SEQ ID NO: 442 - protein, 7 aa, Artificial Sequence
  Synthetic peptide
  misc_feature (3)..(3): Xaa is Serine or Phosphoserine
VLXKYED

SEQ ID NO: 443 - protein, 7 aa, Artificial Sequence
  Synthetic peptide
  misc_feature (2)..(2): Xaa is Serine or Phosphoserine
LXKYEDQ

SEQ ID NO: 444 - protein, 8 aa, Artificial Sequence
  Synthetic peptide
  misc_feature (6)..(6): Xaa is Serine or Phosphoserine
MESVLXKY

SEQ ID NO: 445 - protein, 8 aa, Artificial Sequence
  Synthetic peptide
  misc_feature (5)..(5): Xaa is Serine or Phosphoserine
ESVLXKYE

SEQ ID NO: 446 - protein, 8 aa, Artificial Sequence
  Synthetic peptide
  misc_feature (4)..(4): Xaa is Serine or Phosphoserine
SVLXKYED

SEQ ID NO: 447 - protein, 8 aa, Artificial Sequence
  Synthetic peptide
  misc_feature (3)..(3): Xaa is Serine or Phosphoserine
VLXKYEDQ

SEQ ID NO: 448 - protein, 9 aa, Artificial Sequence
  Synthetic peptide
  misc_feature (6)..(6): Xaa is Serine or Phosphoserine
MESVLXKYE

SEQ ID NO: 449 - protein, 9 aa, Artificial Sequence
  Synthetic peptide
  misc_feature (5)..(5): Xaa is Serine or Phosphoserine
ESVLXKYED

SEQ ID NO: 450 - protein, 9 aa, Artificial Sequence
  Synthetic peptide
  misc_feature (4)..(4): Xaa is Serine or Phosphoserine
SVLXKYEDQ

SEQ ID NO: 451 - protein, 10 aa, Artificial Sequence
  Synthetic peptide
  misc_feature (6)..(6): Xaa is Serine or Phosphoserine
MESVLXKYED

SEQ ID NO: 452 - protein, 10 aa, Artificial Sequence
  Synthetic peptide
  misc_feature (5)..(5): Xaa is Serine or Phosphoserine
ESVLXKYEDQ

SEQ ID NO: 453 - protein, 11 aa, Artificial Sequence
  Synthetic peptide
  misc_feature (6)..(6): Xaa is Serine or Phosphoserine
MESVLXKYEDQ

SEQ ID NO: 454 - protein, 5 aa, Artificial Sequence
  Synthetic peptide
  misc_feature (5)..(5): Xaa is Serine or Phosphoserine
RRKFX

SEQ ID NO: 455 - protein, 5 aa, Artificial Sequence
  Synthetic peptide
  misc_feature (4)..(4): Xaa is Serine or Phosphoserine
RKFXP

SEQ ID NO: 456 - protein, 5 aa, Artificial Sequence
  Synthetic peptide
  misc_feature (3)..(3): Xaa is Serine or Phosphoserine
KFXPI

SEQ ID NO: 457 - protein, 5 aa, Artificial Sequence
  Synthetic peptide
  misc_feature (2)..(2): Xaa is Serine or Phosphoserine
FXPIG

SEQ ID NO: 458 - protein, 5 aa, Artificial Sequence
  Synthetic peptide
  misc_feature (1)..(1): Xaa is Serine or Phosphoserine
XPIGG

SEQ ID NO: 459 - protein, 6 aa, Artificial Sequence
  Synthetic peptide
  misc_feature (6)..(6): Xaa is Serine or Phosphoserine
YRRKFX

SEQ ID NO: 460 - protein, 6 aa, Artificial Sequence
  Synthetic peptide
  misc_feature (5)..(5): Xaa is Serine or Phosphoserine
RRKFXP

SEQ ID NO: 461 - protein, 6 aa, Artificial Sequence
  Synthetic peptide
  misc_feature (4)..(4): Xaa is Serine or Phosphoserine
RKFXPI

SEQ ID NO: 462 - protein, 6 aa, Artificial Sequence
  Synthetic peptide
  misc_feature (3)..(3): Xaa is Serine or Phosphoserine
KFXPIG

SEQ ID NO: 463 - protein, 6 aa, Artificial Sequence
  Synthetic peptide
  misc_feature (2)..(2): Xaa is Serine or Phosphoserine
FXPIGG

SEQ ID NO: 464 - protein, 6 aa, Artificial Sequence
  Synthetic peptide
  misc_feature (1)..(1): Xaa is Serine or Phosphoserine
XPIGGT

SEQ ID NO: 465 - protein, 7 aa, Artificial Sequence
  Synthetic peptide
  misc_feature (6)..(6): Xaa is Serine or Phosphoserine
YRRKFXP

SEQ ID NO: 466 - protein, 7 aa, Artificial Sequence
  Synthetic peptide
  misc_feature (5)..(5): Xaa is Serine or Phosphoserine
RRKFXPI

SEQ ID NO: 467 - protein, 7 aa, Artificial Sequence
  Synthetic peptide
  misc_feature (4)..(4): Xaa is Serine or Phosphoserine
RKFXPIG

SEQ ID NO: 468 - protein, 7 aa, Artificial Sequence
  Synthetic peptide
  misc_feature (3)..(3): Xaa is Serine or Phosphoserine
KFXPIGG

SEQ ID NO: 469 - protein, 7 aa, Artificial Sequence
  Synthetic peptide
  misc_feature (2)..(2): Xaa is Serine or Phosphoserine
FXPIGGT

SEQ ID NO: 470 - protein, 8 aa, Artificial Sequence
  Synthetic peptide
  misc_feature (6)..(6): Xaa is Serine or Phosphoserine
YRRKFXPI

SEQ ID NO: 471 - protein, 8 aa, Artificial Sequence
  Synthetic peptide
  misc_feature (5)..(5): Xaa is Serine or Phosphoserine
RRKFXPIG

SEQ ID NO: 472 - protein, 8 aa, Artificial Sequence
  Synthetic peptide
  misc_feature (4)..(4): Xaa is Serine or Phosphoserine
RKFXPIGG

SEQ ID NO: 473 - protein, 8 aa, Artificial Sequence
  Synthetic peptide
  misc_feature (3)..(3): Xaa is Serine or Phosphoserine
KFXPIGGT

SEQ ID NO: 474 - protein, 9 aa, Artificial Sequence
  Synthetic peptide
  misc_feature (6)..(6): Xaa is Serine or Phosphoserine
YRRKFXPIG

SEQ ID NO: 475 - protein, 9 aa, Artificial Sequence
  Synthetic peptide
  misc_feature (5)..(5): Xaa is Serine or Phosphoserine
RRKFXPIGG

SEQ ID NO: 476 - protein, 9 aa, Artificial Sequence
  Synthetic peptide
  misc_feature (4)..(4): Xaa is Serine or Phosphoserine
RKFXPIGGT

SEQ ID NO: 477 - protein, 10 aa, Artificial Sequence
  Synthetic peptide
  misc_feature (6)..(6): Xaa is Serine or Phosphoserine
YRRKFXPIGG

SEQ ID NO: 478 - protein, 10 aa, Artificial Sequence
  Synthetic peptide
  misc_feature (5)..(5): Xaa is Serine or Phosphoserine
RRKFXPIGGT

SEQ ID NO: 479 - protein, 11 aa, Artificial Sequence
  Synthetic peptide
  misc_feature (6)..(6): Xaa is Serine or Phosphoserine
YRRKFXPIGGT

SEQ ID NO: 480 - protein, 5 aa, Artificial Sequence
  Synthetic peptide
  misc_feature (5)..(5): Xaa is Serine or Phosphoserine
GRDWX

SEQ ID NO: 481 - protein, 5 aa, Artificial Sequence
  Synthetic peptide
  misc_feature (4)..(4): Xaa is Serine or Phosphoserine
RDWXW

SEQ ID NO: 482 - protein, 5 aa, Artificial Sequence
  Synthetic peptide
  misc_feature (3)..(3): Xaa is Serine or Phosphoserine
DWXWE

SEQ ID NO: 483 - protein, 5 aa, Artificial Sequence
  Synthetic peptide
  misc_feature (2)..(2): Xaa is Serine or Phosphoserine
WXWEK

SEQ ID NO: 484 - protein, 5 aa, Artificial Sequence
  Synthetic peptide
  misc_feature (1)..(1): Xaa is Serine or Phosphoserine
XWEKQ

SEQ ID NO: 485 - protein, 6 aa, Artificial Sequence
  Synthetic peptide
  misc_feature (6)..(6): Xaa is Serine or Phosphoserine
LGRDWX

SEQ ID NO: 486 - protein, 6 aa, Artificial Sequence
  Synthetic peptide
  misc_feature (5)..(5): Xaa is Serine or Phosphoserine
GRDWXW

SEQ ID NO: 487 - protein, 6 aa, Artificial Sequence
  Synthetic peptide
  misc_feature (4)..(4): Xaa is Serine or Phosphoserine
RDWXWE

SEQ ID NO: 488 - protein, 6 aa, Artificial Sequence
  Synthetic peptide
  misc_feature (3)..(3): Xaa is Serine or Phosphoserine
DWXWEK

SEQ ID NO: 489 - protein, 6 aa, Artificial Sequence
  Synthetic peptide
  misc_feature (2)..(2): Xaa is Serine or Phosphoserine
WXWEKQ

SEQ ID NO: 490 - protein, 6 aa, Artificial Sequence
  Synthetic peptide
  misc_feature (1)..(1): Xaa is Serine or Phosphoserine
XWEKQK

SEQ ID NO: 491 - protein, 7 aa, Artificial Sequence
  Synthetic peptide
  misc_feature (6)..(6): Xaa is Serine or Phosphoserine
LGRDWXW

SEQ ID NO: 492 - protein, 7 aa, Artificial Sequence
  Synthetic peptide
  misc_feature (5)..(5): Xaa is Serine or Phosphoserine
GRDWXWE

SEQ ID NO: 493 - protein, 7 aa, Artificial Sequence
  Synthetic peptide
  misc_feature (4)..(4): Xaa is Serine or Phosphoserine
RDWXWEK

SEQ ID NO: 494 - protein, 7 aa, Artificial Sequence
  Synthetic peptide
  misc_feature (3)..(3): Xaa is Serine or Phosphoserine
DWXWEKQ

SEQ ID NO: 495 - protein, 7 aa, Artificial Sequence
  Synthetic peptide
  misc_feature (2)..(2): Xaa is Serine or Phosphoserine
WXWEKQK

SEQ ID NO: 496 - protein, 8 aa, Artificial Sequence
  Synthetic peptide
  misc_feature (6)..(6): Xaa is Serine or Phosphoserine
LGRDWXWE

SEQ ID NO: 497 - protein, 8 aa, Artificial Sequence
  Synthetic peptide
  misc_feature (5)..(5): Xaa is Serine or Phosphoserine
GRDWXWEK

SEQ ID NO: 498 - protein, 8 aa, Artificial Sequence
  Synthetic peptide
  misc_feature (4)..(4): Xaa is Serine or Phosphoserine
RDWXWEKQ

SEQ ID NO: 499 - protein, 8 aa, Artificial Sequence
  Synthetic peptide
  misc_feature (3)..(3): Xaa is Serine or Phosphoserine
DWXWEKQK

SEQ ID NO: 500 - protein, 9 aa, Artificial Sequence
  Synthetic peptide
  misc_feature (6)..(6): Xaa is Serine or Phosphoserine
LGRDWXWEK

SEQ ID NO: 501 - protein, 9 aa, Artificial Sequence
  Synthetic peptide
  misc_feature (5)..(5): Xaa is Serine or Phosphoserine
GRDWXWEKQ

SEQ ID NO: 502 - protein, 9 aa, Artificial Sequence
  Synthetic peptide
  misc_feature (4)..(4): Xaa is Serine or Phosphoserine
RDWXWEKQK

SEQ ID NO: 503 - protein, 10 aa, Artificial Sequence
  Synthetic peptide
  misc_feature (6)..(6): Xaa is Serine or Phosphoserine
LGRDWXWEKQ

SEQ ID NO: 504 - protein, 10 aa, Artificial Sequence
  Synthetic peptide
  misc_feature (5)..(5): Xaa is Serine or Phosphoserine
GRDWXWEKQK

SEQ ID NO: 505 - protein, 11 aa, Artificial Sequence
  Synthetic peptide
  misc_feature (6)..(6): Xaa is Serine or Phosphoserine
LGRDWXWEKQK

SEQ ID NO: 506 - protein, 5 aa, Artificial Sequence
  Synthetic peptide
  misc_feature (5)..(5): Xaa is Serine or Phosphoserine
DRKDX

SEQ ID NO: 507 - protein, 5 aa, Artificial Sequence
  Synthetic peptide
  misc_feature (4)..(4): Xaa is Serine or Phosphoserine
RKDXY

SEQ ID NO: 508 - protein, 5 aa, Artificial Sequence
  Synthetic peptide
  misc_feature (3)..(3): Xaa is Serine or Phosphoserine
KDXYY

SEQ ID NO: 509 - protein, 5 aa, Artificial Sequence
  Synthetic peptide
  misc_feature (2)..(2): Xaa is Serine or Phosphoserine
DXYYS

SEQ ID NO: 510 - protein, 5 aa, Artificial Sequence
  Synthetic peptide
  misc_feature (1)..(1): Xaa is Serine or Phosphoserine
XYYSI

SEQ ID NO: 511 - protein, 6 aa, Artificial Sequence
  Synthetic peptide
  misc_feature (6)..(6): Xaa is Serine or Phosphoserine
IDRKDX

SEQ ID NO: 512 - protein, 6 aa, Artificial Sequence
  Synthetic peptide
  misc_feature (5)..(5): Xaa is Serine or Phosphoserine
DRKDXY

SEQ ID NO: 513 - protein, 6 aa, Artificial Sequence
  Synthetic peptide
  misc_feature (4)..(4): Xaa is Serine or Phosphoserine
RKDXYY

SEQ ID NO: 514 - protein, 6 aa, Artificial Sequence
  Synthetic peptide
  misc_feature (3)..(3): Xaa is Serine or Phosphoserine
KDXYYS

SEQ ID NO: 515 - protein, 6 aa, Artificial Sequence
  Synthetic peptide
  misc_feature (2)..(2): Xaa is Serine or Phosphoserine
DXYYSI

SEQ ID NO: 516 - protein, 6 aa, Artificial Sequence
  Synthetic peptide
  misc_feature (1)..(1): Xaa is Serine or Phosphoserine
XYYSIH

SEQ ID NO: 517 - protein, 7 aa, Artificial Sequence
  Synthetic peptide
  misc_feature (6)..(6): Xaa is Serine or Phosphoserine
IDRKDXY

SEQ ID NO: 518 - protein, 7 aa, Artificial Sequence
  Synthetic peptide
  misc_feature (5)..(5): Xaa is Serine or Phosphoserine
DRKDXYY

SEQ ID NO: 519 - protein, 7 aa, Artificial Sequence
  Synthetic peptide
  misc_feature (4)..(4): Xaa is Serine or Phosphoserine
RKDXYYS

SEQ ID NO: 520 - protein, 7 aa, Artificial Sequence
  Synthetic peptide
  misc_feature (3)..(3): Xaa is Serine or Phosphoserine
KDXYYSI

SEQ ID NO: 521 - protein, 7 aa, Artificial Sequence
  Synthetic peptide
  misc_feature (2)..(2): Xaa is Serine or Phosphoserine
DXYYSIH

SEQ ID NO: 522 - protein, 8 aa, Artificial Sequence
  Synthetic peptide
  misc_feature (6)..(6): Xaa is Serine or Phosphoserine
IDRKDXYY

SEQ ID NO: 523 - protein, 8 aa, Artificial Sequence
  Synthetic peptide
  misc_feature (5)..(5): Xaa is Serine or Phosphoserine
DRKDXYYS

SEQ ID NO: 524 - protein, 8 aa, Artificial Sequence
  Synthetic peptide
  misc_feature (4)..(4): Xaa is Serine or Phosphoserine
RKDXYYSI

SEQ ID NO: 525 - protein, 8 aa, Artificial Sequence
  Synthetic peptide
  misc_feature (3)..(3): Xaa is Serine or Phosphoserine
KDXYYSIH

SEQ ID NO: 526 - protein, 9 aa, Artificial Sequence
  Synthetic peptide
  misc_feature (6)..(6): Xaa is Serine or Phosphoserine
IDRKDXYYS

SEQ ID NO: 527 - protein, 9 aa, Artificial Sequence
  Synthetic peptide
  misc_feature (5)..(5): Xaa is Serine or Phosphoserine
DRKDXYYSI

SEQ ID NO: 528 - protein, 9 aa, Artificial Sequence
  Synthetic peptide
  misc_feature (4)..(4): Xaa is Serine or Phosphoserine
RKDXYYSIH

SEQ ID NO: 529 - protein, 10 aa, Artificial Sequence
  Synthetic peptide
  misc_feature (6)..(6): Xaa is Serine or Phosphoserine
IDRKDXYYSI

SEQ ID NO: 530 - protein, 10 aa, Artificial Sequence
  Synthetic peptide
  misc_feature (5)..(5): Xaa is Serine or Phosphoserine
DRKDXYYSIH

SEQ ID NO: 531 - protein, 11 aa, Artificial Sequence
  Synthetic peptide
  misc_feature (6)..(6): Xaa is Serine or Phosphoserine
IDRKDXYYSIH

SEQ ID NO: 532 - protein, 5 aa, Artificial Sequence
  Synthetic peptide
  misc_feature (5)..(5): Xaa is Serine or Phosphoserine
PCRMX

SEQ ID NO: 533 - protein, 5 aa, Artificial Sequence
  Synthetic peptide
  misc_feature (4)..(4): Xaa is Serine or Phosphoserine
CRMXI

SEQ ID NO: 534 - protein, 5 aa, Artificial Sequence
  Synthetic peptide
  misc_feature (3)..(3): Xaa is Serine or Phosphoserine
RMXIA

SEQ ID NO: 535 - protein, 5 aa, Artificial Sequence
  Synthetic peptide
  misc_feature (2)..(2): Xaa is Serine or Phosphoserine
MXIAE

SEQ ID NO: 536 - protein, 5 aa, Artificial Sequence
  Synthetic peptide
  misc_feature (1)..(1): Xaa is Serine or Phosphoserine
XIAEL

SEQ ID NO: 537 - protein, 6 aa, Artificial Sequence
  Synthetic peptide
  misc_feature (6)..(6): Xaa is Serine or Phosphoserine
PPCRMX

SEQ ID NO: 538 - protein, 6 aa, Artificial Sequence
  Synthetic peptide
  misc_feature (5)..(5): Xaa is Serine or Phosphoserine
PCRMXI

SEQ ID NO: 539 - protein, 6 aa, Artificial Sequence
  Synthetic peptide
  misc_feature (4)..(4): Xaa is Serine or Phosphoserine
CRMXIA

SEQ ID NO: 540 - protein, 6 aa, Artificial Sequence
  Synthetic peptide
  misc_feature (3)..(3): Xaa is Serine or Phosphoserine
RMXIAE

SEQ ID NO: 541 - protein, 6 aa, Artificial Sequence
  Synthetic peptide
  misc_feature (2)..(2): Xaa is Serine or Phosphoserine
MXIAEL

SEQ ID NO: 542 - protein, 6 aa, Artificial Sequence
  Synthetic peptide
  misc_feature (1)..(1): Xaa is Serine or Phosphoserine
XIAELD

SEQ ID NO: 543 - protein, 7 aa, Artificial Sequence
  Synthetic peptide
  misc_feature (6)..(6): Xaa is Serine or Phosphoserine
PPCRMXI

SEQ ID NO: 544 - protein, 7 aa, Artificial Sequence
  Synthetic peptide
  misc_feature (5)..(5): Xaa is Serine or Phosphoserine
PCRMXIA

SEQ ID NO: 545 - protein, 7 aa, Artificial Sequence
  Synthetic peptide
  misc_feature (4)..(4): Xaa is Serine or Phosphoserine
CRMXIAE

SEQ ID NO: 546 - protein, 7 aa, Artificial Sequence
  Synthetic peptide
  misc_feature (3)..(3): Xaa is Serine or Phosphoserine
RMXIAEL

SEQ ID NO: 547 - protein, 7 aa, Artificial Sequence
  Synthetic peptide
  misc_feature (2)..(2): Xaa is Serine or Phosphoserine
MXIAELD

SEQ ID NO: 548 - protein, 8 aa, Artificial Sequence
  Synthetic peptide
  misc_feature (6)..(6): Xaa is Serine or Phosphoserine
PPCRMXIA

SEQ ID NO: 549 - protein, 8 aa, Artificial Sequence
  Synthetic peptide
  misc_feature (5)..(5): Xaa is Serine or Phosphoserine
PCRMXIAE

SEQ ID NO: 550 - protein, 8 aa, Artificial Sequence
  Synthetic peptide
  misc_feature (4)..(4): Xaa is Serine or Phosphoserine
CRMXIAEL

SEQ ID NO: 551 - protein, 8 aa, Artificial Sequence
  Synthetic peptide
  misc_feature (3)..(3): Xaa is Serine or Phosphoserine
RMXIAELD

SEQ ID NO: 552 - protein, 9 aa, Artificial Sequence
  Synthetic peptide
  misc_feature (6)..(6): Xaa is Serine or Phosphoserine
PPCRMXIAE

SEQ ID NO: 553 - protein, 9 aa, Artificial Sequence
  Synthetic peptide
  misc_feature (5)..(5): Xaa is Serine or Phosphoserine
PCRMXIAEL

SEQ ID NO: 554 - protein, 9 aa, Artificial Sequence
  Synthetic peptide
  misc_feature (4)..(4): Xaa is Serine or Phosphoserine
CRMXIAELD

SEQ ID NO: 555 - protein, 10 aa, Artificial Sequence
  Synthetic peptide
  misc_feature (6)..(6): Xaa is Serine or Phosphoserine
PPCRMXIAEL

SEQ ID NO: 556 - protein, 10 aa, Artificial Sequence
  Synthetic peptide
  misc_feature (5)..(5): Xaa is Serine or Phosphoserine
PCRMXIAELD

SEQ ID NO: 557 - protein, 11 aa, Artificial Sequence
  Synthetic peptide
  misc_feature (6)..(6): Xaa is Serine or Phosphoserine
PPCRMXIAELD

SEQ ID NO: 558 - protein, 5 aa, Artificial Sequence
  Synthetic peptide
  misc_feature (5)..(5): Xaa is Serine or Phosphoserine
EASLX

SEQ ID NO: 559 - protein, 5 aa, Artificial Sequence
  Synthetic peptide
  misc_feature (4)..(4): Xaa is Serine or Phosphoserine
ASLXG

SEQ ID NO: 560 - protein, 5 aa, Artificial Sequence
  Synthetic peptide
  misc_feature (3)..(3): Xaa is Serine or Phosphoserine
SLXGE

SEQ ID NO: 561 - protein, 5 aa, Artificial Sequence
  Synthetic peptide
  misc_feature (2)..(2): Xaa is Serine or Phosphoserine
LXGER

SEQ ID NO: 562 - protein, 5 aa, Artificial Sequence
  Synthetic peptide
  misc_feature (1)..(1): Xaa is Serine or Phosphoserine
XGERE

SEQ ID NO: 563 - protein, 6 aa, Artificial Sequence
  Synthetic peptide
  misc_feature (6)..(6): Xaa is Serine or Phosphoserine
FEASLX

SEQ ID NO: 564 - protein, 6 aa, Artificial Sequence
  Synthetic peptide
  misc_feature (5)..(5): Xaa is Serine or Phosphoserine
EASLXG

SEQ ID NO: 565 - protein, 6 aa, Artificial Sequence
  Synthetic peptide
  misc_feature (4)..(4): Xaa is Serine or Phosphoserine
ASLXGE

SEQ ID NO: 566 - protein, 6 aa, Artificial Sequence
  Synthetic peptide
  misc_feature (3)..(3): Xaa is Serine or Phosphoserine
SLXGER

SEQ ID NO: 567 - protein, 6 aa, Artificial Sequence
  Synthetic peptide
  misc_feature (2)..(2): Xaa is Serine or Phosphoserine
LXGERE

SEQ ID NO: 568 - protein, 6 aa, Artificial Sequence
  Synthetic peptide
  misc_feature (1)..(1): Xaa is Serine or Phosphoserine
XGEREF

SEQ ID NO: 569 - protein, 7 aa, Artificial Sequence
  Synthetic peptide
  misc_feature (6)..(6): Xaa is Serine or Phosphoserine
FEASLXG

SEQ ID NO: 570 - protein, 7 aa, Artificial Sequence
  Synthetic peptide
  misc_feature (5)..(5): Xaa is Serine or Phosphoserine
EASLXGE

SEQ ID NO: 571 - protein, 7 aa, Artificial Sequence
  Synthetic peptide
  misc_feature (4)..(4): Xaa is Serine or Phosphoserine
ASLXGER

SEQ ID NO: 572 - protein, 7 aa, Artificial Sequence
  Synthetic peptide
  misc_feature (3)..(3): Xaa is Serine or Phosphoserine
SLXGERE

SEQ ID NO: 573 - protein, 7 aa, Artificial Sequence
  Synthetic peptide
  misc_feature (2)..(2): Xaa is Serine or Phosphoserine
LXGEREF

SEQ ID NO: 574 - protein, 8 aa, Artificial Sequence
  Synthetic peptide
  misc_feature (6)..(6): Xaa is Serine or Phosphoserine
FEASLXGE

SEQ ID NO: 575 - protein, 8 aa, Artificial Sequence
  Synthetic peptide
  misc_feature (5)..(5): Xaa is Serine or Phosphoserine
EASLXGER

SEQ ID NO: 576 - protein, 8 aa, Artificial Sequence
  Synthetic peptide
  misc_feature (4)..(4): Xaa is Serine or Phosphoserine
ASLXGERE

SEQ ID NO: 577 - protein, 8 aa, Artificial Sequence
  Synthetic peptide
  misc_feature (3)..(3): Xaa is Serine or Phosphoserine
SLXGEREF

SEQ ID NO: 578 - protein, 9 aa, Artificial Sequence
  Synthetic peptide
  misc_feature (6)..(6): Xaa is Serine or Phosphoserine
FEASLXGER

SEQ ID NO: 579 - protein, 9 aa, Artificial Sequence
  Synthetic peptide
  misc_feature (5)..(5): Xaa is Serine or Phosphoserine
EASLXGERE

SEQ ID NO: 580 - protein, 9 aa, Artificial Sequence
  Synthetic peptide
  misc_feature (4)..(4): Xaa is Serine or Phosphoserine
ASLXGEREF

SEQ ID NO: 581 - protein, 10 aa, Artificial Sequence
  Synthetic peptide
  misc_feature (6)..(6): Xaa is Serine or Phosphoserine
FEASLXGERE

SEQ ID NO: 582 - protein, 10 aa, Artificial Sequence
  Synthetic peptide
  misc_feature (5)..(5): Xaa is Serine or Phosphoserine
EASLXGEREF

SEQ ID NO: 583 - protein, 11 aa, Artificial Sequence
  Synthetic peptide
  misc_feature (6)..(6): Xaa is Serine or Phosphoserine
FEASLXGEREF

SEQ ID NO: 584 - protein, 5 aa, Artificial Sequence
  Synthetic peptide
  misc_feature (5)..(5): Xaa is Serine or Phosphoserine
TPTIX

SEQ ID NO: 585 - protein, 5 aa, Artificial Sequence
  Synthetic peptide
  misc_feature (4)..(4): Xaa is Serine or Phosphoserine
PTIXL

SEQ ID NO: 586 - protein, 5 aa, Artificial Sequence
  Synthetic peptide
  misc_feature (3)..(3): Xaa is Serine or Phosphoserine
TIXLK

SEQ ID NO: 587 - protein, 5 aa, Artificial Sequence
  Synthetic peptide
  misc_feature (2)..(2): Xaa is Serine or Phosphoserine
IXLKE

SEQ ID NO: 588 - protein, 5 aa, Artificial Sequence
  Synthetic peptide
  misc_feature (1)..(1): Xaa is Serine or Phosphoserine
XLKET

SEQ ID NO: 589 - protein, 6 aa, Artificial Sequence
  Synthetic peptide
  misc_feature (6)..(6): Xaa is Serine or Phosphoserine
KTPTIX

SEQ ID NO: 590 - protein, 6 aa, Artificial Sequence
  Synthetic peptide
  misc_feature (5)..(5): Xaa is Serine or Phosphoserine
TPTIXL

SEQ ID NO: 591 - protein, 6 aa, Artificial Sequence
  Synthetic peptide
  misc_feature (4)..(4): Xaa is Serine or Phosphoserine
PTIXLK

SEQ ID NO: 592 - protein, 6 aa, Artificial Sequence
  Synthetic peptide
  misc_feature (3)..(3): Xaa is Serine or Phosphoserine
TIXLKE

SEQ ID NO: 593 - protein, 6 aa, Artificial Sequence
  Synthetic peptide
  misc_feature (2)..(2): Xaa is Serine or Phosphoserine
IXLKET

SEQ ID NO: 594 - protein, 6 aa, Artificial Sequence
  Synthetic peptide
  misc_feature (1)..(1): Xaa is Serine or Phosphoserine
XLKETI

SEQ ID NO: 595 - protein, 7 aa, Artificial Sequence
  Synthetic peptide
  misc_feature (6)..(6): Xaa is Serine or Phosphoserine
KTPTIXL

SEQ ID NO: 596 - protein, 7 aa, Artificial Sequence
  Synthetic peptide
  misc_feature (5)..(5): Xaa is Serine or Phosphoserine
TPTIXLK

SEQ ID NO: 597 - protein, 7 aa, Artificial Sequence
  Synthetic peptide
  misc_feature (4)..(4): Xaa is Serine or Phosphoserine
PTIXLKE

SEQ ID NO: 598 - protein, 7 aa, Artificial Sequence
  Synthetic peptide
  misc_feature (3)..(3): Xaa is Serine or Phosphoserine
TIXLKET

SEQ ID NO: 599 - protein, 7 aa, Artificial Sequence
  Synthetic peptide
  misc_feature (2)..(2): Xaa is Serine or Phosphoserine
IXLKETI

SEQ ID NO: 600 - protein, 8 aa, Artificial Sequence
  Synthetic peptide
  misc_feature (6)..(6): Xaa is Serine or Phosphoserine
KTPTIXLK

SEQ ID NO: 601 - protein, 8 aa, Artificial Sequence
  Synthetic peptide
  misc_feature (5)..(5): Xaa is Serine or Phosphoserine
TPTIXLKE

SEQ ID NO: 602 - protein, 8 aa, Artificial Sequence
  Synthetic peptide
  misc_feature (4)..(4): Xaa is Serine or Phosphoserine
PTIXLKET

SEQ ID NO: 603 - protein, 8 aa, Artificial Sequence
  Synthetic peptide
  misc_feature (3)..(3): Xaa is Serine or Phosphoserine
TIXLKETI

SEQ ID NO: 604 - protein, 9 aa, Artificial Sequence
  Synthetic peptide
  misc_feature (6)..(6): Xaa is Serine or Phosphoserine
KTPTIXLKE

SEQ ID NO: 605 - protein, 9 aa, Artificial Sequence
  Synthetic peptide
  misc_feature (5)..(5): Xaa is Serine or Phosphoserine
TPTIXLKET

SEQ ID NO: 606 - protein, 9 aa, Artificial Sequence
  Synthetic peptide
  misc_feature (4)..(4): Xaa is Serine or Phosphoserine
PTIXLKETI

SEQ ID NO: 607 - protein, 10 aa, Artificial Sequence
  Synthetic peptide
  misc_feature (6)..(6): Xaa is Serine or Phosphoserine
KTPTIXLKET

SEQ ID NO: 608 - protein, 10 aa, Artificial Sequence
  Synthetic peptide
  misc_feature (5)..(5): Xaa is Serine or Phosphoserine
TPTIXLKETI

SEQ ID NO: 609 - protein, 11 aa, Artificial Sequence
  Synthetic peptide
  misc_feature (6)..(6): Xaa is Serine or Phosphoserine
KTPTIXLKETI

SEQ ID NO: 610 - protein, 5 aa, Artificial Sequence
  Synthetic peptide
  misc_feature (5)..(5): Xaa is Serine or Phosphoserine
YGKKX

SEQ ID NO: 611 - protein, 5 aa, Artificial Sequence
  Synthetic peptide
  misc_feature (4)..(4): Xaa is Serine or Phosphoserine
GKKXG

SEQ ID NO: 612 - protein, 5 aa, Artificial Sequence
  Synthetic peptide
  misc_feature (3)..(3): Xaa is Serine or Phosphoserine
KKXGK

SEQ ID NO: 613 - protein, 5 aa, Artificial Sequence
  Synthetic peptide
  misc_feature (2)..(2): Xaa is Serine or Phosphoserine
KXGKK

SEQ ID NO: 614 - protein, 5 aa, Artificial Sequence
  Synthetic peptide
  misc_feature (1)..(1): Xaa is Serine or Phosphoserine
XGKKA

SEQ ID NO: 615 - protein, 6 aa, Artificial Sequence
  Synthetic peptide
  misc_feature (6)..(6): Xaa is Serine or Phosphoserine
EYGKKX

SEQ ID NO: 616 - protein, 6 aa, Artificial Sequence
  Synthetic peptide
  misc_feature (5)..(5): Xaa is Serine or Phosphoserine
YGKKXG

SEQ ID NO: 617 - protein, 6 aa, Artificial Sequence
  Synthetic peptide
  misc_feature (4)..(4): Xaa is Serine or Phosphoserine
GKKXGK

SEQ ID NO: 618 - protein, 6 aa, Artificial Sequence
  Synthetic peptide
  misc_feature (3)..(3): Xaa is Serine or Phosphoserine
KKXGKK

SEQ ID NO: 619 - protein, 6 aa, Artificial Sequence
  Synthetic peptide
  misc_feature (2)..(2): Xaa is Serine or Phosphoserine
KXGKKA

SEQ ID NO: 620 - protein, 6 aa, Artificial Sequence
  Synthetic peptide
  misc_feature (1)..(1): Xaa is Serine or Phosphoserine
XGKKAG

SEQ ID NO: 621 - protein, 7 aa, Artificial Sequence
  Synthetic peptide
  misc_feature (6)..(6): Xaa is Serine or Phosphoserine
EYGKKXG

SEQ ID NO: 622 - protein, 7 aa, Artificial Sequence
  Synthetic peptide
  misc_feature (5)..(5): Xaa is Serine or Phosphoserine
YGKKXGK

SEQ ID NO: 623 - protein, 7 aa, Artificial Sequence
  Synthetic peptide
  misc_feature (4)..(4): Xaa is Serine or Phosphoserine
GKKXGKK

SEQ ID NO: 624 - protein, 7 aa, Artificial Sequence
  Synthetic peptide
  misc_feature (3)..(3): Xaa is Serine or Phosphoserine
KKXGKKA

SEQ ID NO: 625 - protein, 7 aa, Artificial Sequence
  Synthetic peptide
  misc_feature (2)..(2): Xaa is Serine or Phosphoserine
KXGKKAG

SEQ ID NO: 626 - protein, 8 aa, Artificial Sequence
  Synthetic peptide
  misc_feature (6)..(6): Xaa is Serine or Phosphoserine
EYGKKXGK

SEQ ID NO: 627 - protein, 8 aa, Artificial Sequence
  Synthetic peptide
  misc_feature (5)..(5): Xaa is Serine or Phosphoserine
YGKKXGKK

SEQ ID NO: 628 - protein, 8 aa, Artificial Sequence
  Synthetic peptide
  misc_feature (4)..(4): Xaa is Serine or Phosphoserine
GKKXGKKA

SEQ ID NO: 629 - protein, 8 aa, Artificial Sequence
  Synthetic peptide
  misc_feature (3)..(3): Xaa is Serine or Phosphoserine
KKXGKKAG

SEQ ID NO: 630 - protein, 9 aa, Artificial Sequence
  Synthetic peptide
  misc_feature (6)..(6): Xaa is Serine or Phosphoserine
EYGKKXGKK

SEQ ID NO: 631 - protein, 9 aa, Artificial Sequence
  Synthetic peptide
  misc_feature (5)..(5): Xaa is Serine or Phosphoserine
YGKKXGKKA

SEQ ID NO: 632 - protein, 9 aa, Artificial Sequence
  Synthetic peptide
  misc_feature (4)..(4): Xaa is Serine or Phosphoserine
GKKXGKKAG

SEQ ID NO: 633 - protein, 10 aa, Artificial Sequence
  Synthetic peptide
  misc_feature (6)..(6): Xaa is Serine or Phosphoserine
EYGKKXGKKA

SEQ ID NO: 634 - protein, 10 aa, Artificial Sequence
  Synthetic peptide
  misc_feature (5)..(5): Xaa is Serine or Phosphoserine
YGKKXGKKAG

SEQ ID NO: 635 - protein, 11 aa, Artificial Sequence
  Synthetic peptide
  misc_feature (6)..(6): Xaa is Serine or Phosphoserine
EYGKKXGKKAG

SEQ ID NO: 636 - protein, 5 aa, Artificial Sequence
  Synthetic peptide
  misc_feature (5)..(5): Xaa is Serine or Phosphoserine
FKRAX

SEQ ID NO: 637 - protein, 5 aa, Artificial Sequence
  Synthetic peptide
  misc_feature (4)..(4): Xaa is Serine or Phosphoserine
KRAXE

SEQ ID NO: 638 - protein, 5 aa, Artificial Sequence
  Synthetic peptide
  misc_feature (3)..(3): Xaa is Serine or Phosphoserine
RAXEE

SEQ ID NO: 639 - protein, 5 aa, Artificial Sequence
  Synthetic peptide
  misc_feature (2)..(2): Xaa is Serine or Phosphoserine
AXEEI

SEQ ID NO: 640 - protein, 5 aa, Artificial Sequence
  Synthetic peptide
  misc_feature (1)..(1): Xaa is Serine or Phosphoserine
XEEIT

SEQ ID NO: 641 - protein, 6 aa, Artificial Sequence
  Synthetic peptide
  misc_feature (6)..(6): Xaa is Serine or Phosphoserine
DFKRAX

SEQ ID NO: 642 - protein, 6 aa, Artificial Sequence
  Synthetic peptide
  misc_feature (5)..(5): Xaa is Serine or Phosphoserine
FKRAXE

SEQ ID NO: 643 - protein, 6 aa, Artificial Sequence
  Synthetic peptide
  misc_feature (4)..(4): Xaa is Serine or Phosphoserine
KRAXEE

SEQ ID NO: 644 - protein, 6 aa, Artificial Sequence
  Synthetic peptide
  misc_feature (3)..(3): Xaa is Serine or Phosphoserine
RAXEEI

SEQ ID NO: 645 - protein, 6 aa, Artificial Sequence
  Synthetic peptide
  misc_feature (2)..(2): Xaa is Serine or Phosphoserine
AXEEIT

SEQ ID NO: 646 - protein, 6 aa, Artificial Sequence
  Synthetic peptide
  misc_feature (1)..(1): Xaa is Serine or Phosphoserine
XEEITK

SEQ ID NO: 647 - protein, 7 aa, Artificial Sequence
  Synthetic peptide
  misc_feature (6)..(6): Xaa is Serine or Phosphoserine
DFKRAXE

SEQ ID NO: 648 - protein, 7 aa, Artificial Sequence
  Synthetic peptide
  misc_feature (5)..(5): Xaa is Serine or Phosphoserine
FKRAXEE

SEQ ID NO: 649 - protein, 7 aa, Artificial Sequence
  Synthetic peptide
  misc_feature (4)..(4): Xaa is Serine or Phosphoserine
KRAXEEI

SEQ ID NO: 650 - protein, 7 aa, Artificial Sequence
  Synthetic peptide
  misc_feature (3)..(3): Xaa is Serine or Phosphoserine
RAXEEIT

SEQ ID NO: 651 - protein, 7 aa, Artificial Sequence
  Synthetic peptide
  misc_feature (2)..(2): Xaa is Serine or Phosphoserine
AXEEITK

SEQ ID NO: 652 - protein, 8 aa, Artificial Sequence
  Synthetic peptide
  misc_feature (6)..(6): Xaa is Serine or Phosphoserine
DFKRAXEE

SEQ ID NO: 653 - protein, 8 aa, Artificial Sequence
  Synthetic peptide
  misc_feature (5)..(5): Xaa is Serine or Phosphoserine
FKRAXEEI

SEQ ID NO: 654 - protein, 8 aa, Artificial Sequence
  Synthetic peptide
  misc_feature (4)..(4): Xaa is Serine or Phosphoserine
KRAXEEIT

SEQ ID NO: 655 - protein, 8 aa, Artificial Sequence
  Synthetic peptide
  misc_feature (3)..(3): Xaa is Serine or Phosphoserine
RAXEEITK

SEQ ID NO: 656 - protein, 9 aa, Artificial Sequence
  Synthetic peptide
  misc_feature (6)..(6): Xaa is Serine or Phosphoserine
DFKRAXEEI

SEQ ID NO: 657 - protein, 9 aa, Artificial Sequence
  Synthetic peptide
  misc_feature (5)..(5): Xaa is Serine or Phosphoserine
FKRAXEEIT

SEQ ID NO: 658 - protein, 9 aa, Artificial Sequence
  Synthetic peptide
  misc_feature (4)..(4): Xaa is Serine or Phosphoserine
KRAXEEITK

SEQ ID NO: 659 - protein, 10 aa, Artificial Sequence
  Synthetic peptide
  misc_feature (6)..(6): Xaa is Serine or Phosphoserine
DFKRAXEEIT

SEQ ID NO: 660 - protein, 10 aa, Artificial Sequence
  Synthetic peptide
  misc_feature (5)..(5): Xaa is Serine or Phosphoserine
FKRAXEEITK

SEQ ID NO: 661 - protein, 11 aa, Artificial Sequence
  Synthetic peptide
  misc_feature (6)..(6): Xaa is Serine or Phosphoserine
DFKRAXEEITK

SEQ ID NO: 662 - protein, 5 aa, Artificial Sequence
  Synthetic peptide
  misc_feature (5)..(5): Xaa is Serine or Phosphoserine
MLKFX

SEQ ID NO: 663 - protein, 5 aa, Artificial Sequence
  Synthetic peptide
  misc_feature (4)..(4): Xaa is Serine or Phosphoserine
LKFXS

SEQ ID NO: 664 - protein, 5 aa, Artificial Sequence
  Synthetic peptide
  misc_feature (3)..(3): Xaa is Serine or Phosphoserine
KFXSK

SEQ ID NO: 665 - protein, 5 aa, Artificial Sequence
  Synthetic peptide
  misc_feature (2)..(2): Xaa is Serine or Phosphoserine
FXSKE

SEQ ID NO: 666 - protein, 5 aa, Artificial Sequence
  Synthetic peptide
  misc_feature (1)..(1): Xaa is Serine or Phosphoserine
XSKEK

SEQ ID NO: 667 - protein, 6 aa, Artificial Sequence
  Synthetic peptide
  misc_feature (6)..(6): Xaa is Serine or Phosphoserine
KMLKFX

SEQ ID NO: 668 - protein, 6 aa, Artificial Sequence
  Synthetic peptide
  misc_feature (5)..(5): Xaa is Serine or Phosphoserine
MLKFXS

SEQ ID NO: 669 - protein, 6 aa, Artificial Sequence
  Synthetic peptide
  misc_feature (4)..(4): Xaa is Serine or Phosphoserine
LKFXSK

SEQ ID NO: 670 - protein, 6 aa, Artificial Sequence
  Synthetic peptide
  misc_feature (3)..(3): Xaa is Serine or Phosphoserine
KFXSKE

SEQ ID NO: 671 - protein, 6 aa, Artificial Sequence
  Synthetic peptide
  misc_feature (2)..(2): Xaa is Serine or Phosphoserine
FXSKEK

SEQ ID NO: 672 - protein, 6 aa, Artificial Sequence
  Synthetic peptide
  misc_feature (1)..(1): Xaa is Serine or Phosphoserine
XSKEKY

SEQ ID NO: 673 - protein, 7 aa, Artificial Sequence
  Synthetic peptide
  misc_feature (6)..(6): Xaa is Serine or Phosphoserine
KMLKFXS

SEQ ID NO: 674 - protein, 7 aa, Artificial Sequence
  Synthetic peptide
  misc_feature (5)..(5): Xaa is Serine or Phosphoserine
MLKFXSK

SEQ ID NO: 675 - protein, 7 aa, Artificial Sequence
  Synthetic peptide
  misc_feature (4)..(4): Xaa is Serine or Phosphoserine
LKFXSKE

SEQ ID NO: 676 - protein, 7 aa, Artificial Sequence
  Synthetic peptide
  misc_feature (3)..(3): Xaa is Serine or Phosphoserine
KFXSKEK

SEQ ID NO: 677 - protein, 7 aa, Artificial Sequence
  Synthetic peptide
  misc_feature (2)..(2): Xaa is Serine or Phosphoserine
FXSKEKY

SEQ ID NO: 678 - protein, 8 aa, Artificial Sequence
  Synthetic peptide
  misc_feature (6)..(6): Xaa is Serine or Phosphoserine
KMLKFXSK

SEQ ID NO: 679 - protein, 8 aa, Artificial Sequence
  Synthetic peptide
  misc_feature (5)..(5): Xaa is Serine or Phosphoserine
MLKFXSKE

SEQ ID NO: 680 - protein, 8 aa, Artificial Sequence
  Synthetic peptide
  misc_feature (4)..(4): Xaa is Serine or Phosphoserine
LKFXSKEK

SEQ ID NO: 681 - protein, 8 aa, Artificial Sequence
  Synthetic peptide
  misc_feature (3)..(3): Xaa is Serine or Phosphoserine
KFXSKEKY

SEQ ID NO: 682 - protein, 9 aa, Artificial Sequence
  Synthetic peptide
  misc_feature (6)..(6): Xaa is Serine or Phosphoserine
KMLKFXSKE

SEQ ID NO: 683 - protein, 9 aa, Artificial Sequence
  Synthetic peptide
  misc_feature (5)..(5): Xaa is Serine or Phosphoserine
MLKFXSKEK

SEQ ID NO: 684 - protein, 9 aa, Artificial Sequence
  Synthetic peptide
  misc_feature (4)..(4): Xaa is Serine or Phosphoserine
LKFXSKEKY

SEQ ID NO: 685 - protein, 10 aa, Artificial Sequence
  Synthetic peptide
  misc_feature (6)..(6): Xaa is Serine or Phosphoserine
KMLKFXSKEK

SEQ ID NO: 686 - protein, 10 aa, Artificial Sequence
  Synthetic peptide
  misc_feature (5)..(5): Xaa is Serine or Phosphoserine
MLKFXSKEKY

SEQ ID NO: 687 - protein, 11 aa, Artificial Sequence
  Synthetic peptide
  misc_feature (6)..(6): Xaa is Serine or Phosphoserine
KMLKFXSKEKY

SEQ ID NO: 688 - protein, 5 aa, Artificial Sequence
  Synthetic peptide
  misc_feature (5)..(5): Xaa is Serine or Phosphoserine
LKRFX

SEQ ID NO: 689 - protein, 5 aa, Artificial Sequence
  Synthetic peptide
  misc_feature (4)..(4): Xaa is Serine or Phosphoserine
KRFXT

SEQ ID NO: 690 - protein, 5 aa, Artificial Sequence
  Synthetic peptide
  misc_feature (3)..(3): Xaa is Serine or Phosphoserine
RFXTE

SEQ ID NO: 691 - protein, 5 aa, Artificial Sequence
  Synthetic peptide
  misc_feature (2)..(2): Xaa is Serine or Phosphoserine
FXTEE

SEQ ID NO: 692 - protein, 5 aa, Artificial Sequence
  Synthetic peptide
  misc_feature (1)..(1): Xaa is Serine or Phosphoserine
XTEEF

SEQ ID NO: 693 - protein, 6 aa, Artificial Sequence
  Synthetic peptide
  misc_feature (6)..(6): Xaa is Serine or Phosphoserine
QLKRFX

SEQ ID NO: 694 - protein, 6 aa, Artificial Sequence
  Synthetic peptide
  misc_feature (5)..(5): Xaa is Serine or Phosphoserine
LKRFXT

SEQ ID NO: 695 - protein, 6 aa, Artificial Sequence
  Synthetic peptide
  misc_feature (4)..(4): Xaa is Serine or Phosphoserine
KRFXTE

SEQ ID NO: 696 - protein, 6 aa, Artificial Sequence
  Synthetic peptide
  misc_feature (3)..(3): Xaa is Serine or Phosphoserine
RFXTEE

SEQ ID NO: 697 - protein, 6 aa, Artificial Sequence
  Synthetic peptide
  misc_feature (2)..(2): Xaa is Serine or Phosphoserine
FXTEEF

SEQ ID NO: 698 - protein, 6 aa, Artificial Sequence
  Synthetic peptide
  misc_feature (1)..(1): Xaa is Serine or Phosphoserine
XTEEFV

SEQ ID NO: 699 - protein, 7 aa, Artificial Sequence
  Synthetic peptide
  misc_feature (6)..(6): Xaa is Serine or Phosphoserine
QLKRFXT

SEQ ID NO: 700 - protein, 7 aa, Artificial Sequence
  Synthetic peptide
  misc_feature (5)..(5): Xaa is Serine or Phosphoserine
LKRFXTE

SEQ ID NO: 701 - protein, 7 aa, Artificial Sequence
  Synthetic peptide
  misc_feature (4)..(4): Xaa is Serine or Phosphoserine
KRFXTEE

SEQ ID NO: 702 - protein, 7 aa, Artificial Sequence
  Synthetic peptide
  misc_feature (3)..(3): Xaa is Serine or Phosphoserine
RFXTEEF

SEQ ID NO: 703 - protein, 7 aa, Artificial Sequence
  Synthetic peptide
  misc_feature (2)..(2): Xaa is Serine or Phosphoserine
FXTEEFV

SEQ ID NO: 704 - protein, 8 aa, Artificial Sequence
  Synthetic peptide
  misc_feature (6)..(6): Xaa is Serine or Phosphoserine
QLKRFXTE

SEQ ID NO: 705 - protein, 8 aa, Artificial Sequence
  Synthetic peptide
  misc_feature (5)..(5): Xaa is Serine or Phosphoserine
LKRFXTEE

SEQ ID NO: 706 - protein, 8 aa, Artificial Sequence
  Synthetic peptide
  misc_feature (4)..(4): Xaa is Serine or Phosphoserine
KRFXTEEF

SEQ ID NO: 707 - protein, 8 aa, Artificial Sequence
  Synthetic peptide
  misc_feature (3)..(3): Xaa is Serine or Phosphoserine
RFXTEEFV

SEQ ID NO: 708 - protein, 9 aa, Artificial Sequence
  Synthetic peptide
  misc_feature (6)..(6): Xaa is Serine or Phosphoserine
QLKRFXTEE

SEQ ID NO: 709 - protein, 9 aa, Artificial Sequence
  Synthetic peptide
  misc_feature (5)..(5): Xaa is Serine or Phosphoserine
LKRFXTEEF

SEQ ID NO: 710 - protein, 9 aa, Artificial Sequence
  Synthetic peptide
  misc_feature (4)..(4): Xaa is Serine or Phosphoserine
KRFXTEEFV

SEQ ID NO: 711 - protein, 10 aa, Artificial Sequence
  Synthetic peptide
  misc_feature (6)..(6): Xaa is Serine or Phosphoserine
QLKRFXTEEF

SEQ ID NO: 712 - protein, 10 aa, Artificial Sequence
  Synthetic peptide
  misc_feature (5)..(5): Xaa is Serine or Phosphoserine
LKRFXTEEFV

SEQ ID NO: 713 - protein, 11 aa, Artificial Sequence
  Synthetic peptide
  misc_feature (6)..(6): Xaa is Serine or Phosphoserine
QLKRFXTEEFV

SEQ ID NO: 714 - protein, 5 aa, Artificial Sequence
  Synthetic peptide
  misc_feature (5)..(5): Xaa is Serine or Phosphoserine
YRSSX

SEQ ID NO: 715 - protein, 5 aa, Artificial Sequence
  Synthetic peptide
  misc_feature (4)..(4): Xaa is Serine or Phosphoserine
RSSXP

SEQ ID NO: 716 - protein, 5 aa, Artificial Sequence
  Synthetic peptide
  misc_feature (3)..(3): Xaa is Serine or Phosphoserine
SSXPE

SEQ ID NO: 717 - protein, 5 aa, Artificial Sequence
  Synthetic peptide
  misc_feature (2)..(2): Xaa is Serine or Phosphoserine
SXPED

SEQ ID NO: 718 - protein, 5 aa, Artificial Sequence
  Synthetic peptide
  misc_feature (1)..(1): Xaa is Serine or Phosphoserine
XPEDA

SEQ ID NO: 719 - protein, 6 aa, Artificial Sequence
  Synthetic peptide
  misc_feature (6)..(6): Xaa is Serine or Phosphoserine
QYRSSX

SEQ ID NO: 720 - protein, 6 aa, Artificial Sequence
  Synthetic peptide
  misc_feature (5)..(5): Xaa is Serine or Phosphoserine
YRSSXP

SEQ ID NO: 721 - protein, 6 aa, Artificial Sequence
  Synthetic peptide
  misc_feature (4)..(4): Xaa is Serine or Phosphoserine
RSSXPE

SEQ ID NO: 722 - protein, 6 aa, Artificial Sequence
  Synthetic peptide
  misc_feature (3)..(3): Xaa is Serine or Phosphoserine
SSXPED

SEQ ID NO: 723 - protein, 6 aa, Artificial Sequence
  Synthetic peptide
  misc_feature (2)..(2): Xaa is Serine or Phosphoserine
SXPEDA

SEQ ID NO: 724 - protein, 6 aa, Artificial Sequence
  Synthetic peptide
  misc_feature (1)..(1): Xaa is Serine or Phosphoserine
XPEDAR

SEQ ID NO: 725 - protein, 7 aa, Artificial Sequence
  Synthetic peptide
  misc_feature (6)..(6): Xaa is Serine or Phosphoserine
QYRSSXP

SEQ ID NO: 726 - protein, 7 aa, Artificial Sequence
  Synthetic peptide
  misc_feature (5)..(5): Xaa is Serine or Phosphoserine
YRSSXPE

SEQ ID NO: 727 - protein, 7 aa, Artificial Sequence
  Synthetic peptide
  misc_feature (4)..(4): Xaa is Serine or Phosphoserine
RSSXPED

SEQ ID NO: 728 - protein, 7 aa, Artificial Sequence
  Synthetic peptide
  misc_feature (3)..(3): Xaa is Serine or Phosphoserine
SSXPEDA

SEQ ID NO: 729 - protein, 7 aa, Artificial Sequence
  Synthetic peptide
  misc_feature (2)..(2): Xaa is Serine or Phosphoserine
SXPEDAR

SEQ ID NO: 730 - protein, 8 aa, Artificial Sequence
  Synthetic peptide
  misc_feature (6)..(6): Xaa is Serine or Phosphoserine
QYRSSXPE

SEQ ID NO: 731 - protein, 8 aa, Artificial Sequence
  Synthetic peptide
  misc_feature (5)..(5): Xaa is Serine or Phosphoserine
YRSSXPED

SEQ ID NO: 732 - protein, 8 aa, Artificial Sequence
  Synthetic peptide
  misc_feature (4)..(4): Xaa is Serine or Phosphoserine
RSSXPEDA

SEQ ID NO: 733 - protein, 8 aa, Artificial Sequence
  Synthetic peptide
  misc_feature (3)..(3): Xaa is Serine or Phosphoserine
SSXPEDAR

SEQ ID NO: 734 - protein, 9 aa, Artificial Sequence
  Synthetic peptide
  misc_feature (6)..(6): Xaa is Serine or Phosphoserine
QYRSSXPED

SEQ ID NO: 735 - protein, 9 aa, Artificial Sequence
  Synthetic peptide
  misc_feature (5)..(5): Xaa is Serine or Phosphoserine
YRSSXPEDA

SEQ ID NO: 736 - protein, 9 aa, Artificial Sequence
  Synthetic peptide
  misc_feature (4)..(4): Xaa is Serine or Phosphoserine
RSSXPEDAR

SEQ ID NO: 737 - protein, 10 aa, Artificial Sequence
  Synthetic peptide
  misc_feature (6)..(6): Xaa is Serine or Phosphoserine
QYRSSXPEDA

SEQ ID NO: 738 - protein, 10 aa, Artificial Sequence
  Synthetic peptide
  misc_feature (5)..(5): Xaa is Serine or Phosphoserine
YRSSXPEDAR

SEQ ID NO: 739 - protein, 11 aa, Artificial Sequence
  Synthetic peptide
  misc_feature (6)..(6): Xaa is Serine or Phosphoserine
QYRSSXPEDAR

SEQ ID NO: 740 - protein, 5 aa, Artificial Sequence
  Synthetic peptide
  misc_feature (5)..(5): Xaa is Serine or Phosphoserine
KPRHX

SEQ ID NO: 741 - protein, 5 aa, Artificial Sequence
  Synthetic peptide
  misc_feature (4)..(4): Xaa is Serine or Phosphoserine
PRHXL

SEQ ID NO: 742 - protein, 5 aa, Artificial Sequence
  Synthetic peptide
  misc_feature (3)..(3): Xaa is Serine or Phosphoserine
RHXLY

SEQ ID NO: 743 - protein, 5 aa, Artificial Sequence
  Synthetic peptide
  misc_feature (2)..(2): Xaa is Serine or Phosphoserine
HXLYF

SEQ ID NO: 744 - protein, 5 aa, Artificial Sequence
  Synthetic peptide
  misc_feature (1)..(1): Xaa is Serine or Phosphoserine
XLYFI

SEQ ID NO: 745 - protein, 6 aa, Artificial Sequence
  Synthetic peptide
  misc_feature (6)..(6): Xaa is Serine or Phosphoserine
GKPRHX

SEQ ID NO: 746 - protein, 6 aa, Artificial Sequence
  Synthetic peptide
  misc_feature (5)..(5): Xaa is Serine or Phosphoserine
KPRHXL

SEQ ID NO: 747 - protein, 6 aa, Artificial Sequence
  Synthetic peptide
  misc_feature (4)..(4): Xaa is Serine or Phosphoserine
PRHXLY

SEQ ID NO: 748 - protein, 6 aa, Artificial Sequence
  Synthetic peptide
  misc_feature (3)..(3): Xaa is Serine or Phosphoserine
RHXLYF

SEQ ID NO: 749 - protein, 6 aa, Artificial Sequence
  Synthetic peptide
  misc_feature (2)..(2): Xaa is Serine or Phosphoserine
HXLYFI

SEQ ID NO: 750 - protein, 6 aa, Artificial Sequence
  Synthetic peptide
  misc_feature (1)..(1): Xaa is Serine or Phosphoserine
XLYFIG

SEQ ID NO: 751 - protein, 7 aa, Artificial Sequence
  Synthetic peptide
  misc_feature (6)..(6): Xaa is Serine or Phosphoserine
GKPRHXL

SEQ ID NO: 752 - protein, 7 aa, Artificial Sequence
  Synthetic peptide
  misc_feature (5)..(5): Xaa is Serine or Phosphoserine
KPRHXLY

SEQ ID NO: 753 - protein, 7 aa, Artificial Sequence
  Synthetic peptide
  misc_feature (4)..(4): Xaa is Serine or Phosphoserine
PRHXLYF

SEQ ID NO: 754 - protein, 7 aa, Artificial Sequence
  Synthetic peptide
  misc_feature (3)..(3): Xaa is Serine or Phosphoserine
RHXLYFI

SEQ ID NO: 755 - protein, 7 aa, Artificial Sequence
  Synthetic peptide
  misc_feature (2)..(2): Xaa is Serine or Phosphoserine
HXLYFIG

SEQ ID NO: 756 - protein, 8 aa, Artificial Sequence
  Synthetic peptide
  misc_feature (6)..(6): Xaa is Serine or Phosphoserine
GKPRHXLY

SEQ ID NO: 757 - protein, 8 aa, Artificial Sequence
  Synthetic peptide
  misc_feature (5)..(5): Xaa is Serine or Phosphoserine
KPRHXLYF

SEQ ID NO: 758 - protein, 8 aa, Artificial Sequence
  Synthetic peptide
  misc_feature (4)..(4): Xaa is Serine or Phosphoserine
PRHXLYFI

SEQ ID NO: 759 - protein, 8 aa, Artificial Sequence
  Synthetic peptide
  misc_feature (3)..(3): Xaa is Serine or Phosphoserine
RHXLYFIG

SEQ ID NO: 760 - protein, 9 aa, Artificial Sequence
  Synthetic peptide
  misc_feature (6)..(6): Xaa is Serine or Phosphoserine
GKPRHXLYF

SEQ ID NO: 761 - protein, 9 aa, Artificial Sequence
  Synthetic peptide
  misc_feature (5)..(5): Xaa is Serine or Phosphoserine
KPRHXLYFI

SEQ ID NO: 762 - protein, 9 aa, Artificial Sequence
  Synthetic peptide
  misc_feature (4)..(4): Xaa is Serine or Phosphoserine
PRHXLYFIG

SEQ ID NO: 763 - protein, 10 aa, Artificial Sequence
  Synthetic peptide
  misc_feature (6)..(6): Xaa is Serine or Phosphoserine
GKPRHXLYFI

SEQ ID NO: 764 - protein, 10 aa, Artificial Sequence
  Synthetic peptide
  misc_feature (5)..(5): Xaa is Serine or Phosphoserine
KPRHXLYFIG

SEQ ID NO: 765 - protein, 11 aa, Artificial Sequence
  Synthetic peptide
  misc_feature (6)..(6): Xaa is Serine or Phosphoserine
GKPRHXLYFIG

SEQ ID NO: 766 - protein, 5 aa, Artificial Sequence
  Synthetic peptide
  misc_feature (5)..(5): Xaa is Serine or Phosphoserine
AKRPX

SEQ ID NO: 767 - protein, 5 aa, Artificial Sequence
  Synthetic peptide
  misc_feature (4)..(4): Xaa is Serine or Phosphoserine
KRPXS

SEQ ID NO: 768 - protein, 5 aa, Artificial Sequence
  Synthetic peptide
  misc_feature (3)..(3): Xaa is Serine or Phosphoserine
RPXSE

SEQ ID NO: 769 - protein, 5 aa, Artificial Sequence
  Synthetic peptide
  misc_feature (2)..(2): Xaa is Serine or Phosphoserine
PXSED

SEQ ID NO: 770 - protein, 5 aa, Artificial Sequence
  Synthetic peptide
  misc_feature (1)..(1): Xaa is Serine or Phosphoserine
XSEDF

SEQ ID NO: 771 - protein, 6 aa, Artificial Sequence
  Synthetic peptide
  misc_feature (6)..(6): Xaa is Serine or Phosphoserine
RAKRPX

SEQ ID NO: 772 - protein, 6 aa, Artificial Sequence
  Synthetic peptide
  misc_feature (5)..(5): Xaa is Serine or Phosphoserine
AKRPXS

SEQ ID NO: 773 - protein, 6 aa, Artificial Sequence
  Synthetic peptide
  misc_feature (4)..(4): Xaa is Serine or Phosphoserine
KRPXSE

SEQ ID NO: 774 - protein, 6 aa, Artificial Sequence
  Synthetic peptide
  misc_feature (3)..(3): Xaa is Serine or Phosphoserine
RPXSED

SEQ ID NO: 775 - protein, 6 aa, Artificial Sequence
  Synthetic peptide
  misc_feature (2)..(2): Xaa is Serine or Phosphoserine
PXSEDF

SEQ ID NO: 776 - protein, 6 aa, Artificial Sequence
  Synthetic peptide
  misc_feature (1)..(1): Xaa is Serine or Phosphoserine
XSEDFV

SEQ ID NO: 777 - protein, 7 aa, Artificial Sequence
  Synthetic peptide
  misc_feature (6)..(6): Xaa is Serine or Phosphoserine
RAKRPXS

SEQ ID NO: 778 - protein, 7 aa, Artificial Sequence
  Synthetic peptide
  misc_feature (5)..(5): Xaa is Serine or Phosphoserine
AKRPXSE

SEQ ID NO: 779 - protein, 7 aa, Artificial Sequence
  Synthetic peptide
  misc_feature (4)..(4): Xaa is Serine or Phosphoserine
KRPXSED

SEQ ID NO: 780 - protein, 7 aa, Artificial Sequence
  Synthetic peptide
  misc_feature (3)..(3): Xaa is Serine or Phosphoserine
RPXSEDF

SEQ ID NO: 781 - protein, 7 aa, Artificial Sequence
  Synthetic peptide
  misc_feature (2)..(2): Xaa is Serine or Phosphoserine
PXSEDFV

SEQ ID NO: 782 - protein, 8 aa, Artificial Sequence
  Synthetic peptide
  misc_feature (6)..(6): Xaa is Serine or Phosphoserine
RAKRPXSE

SEQ ID NO: 783 - protein, 8 aa, Artificial Sequence
  Synthetic peptide
  misc_feature (5)..(5): Xaa is Serine or Phosphoserine
AKRPXSED

SEQ ID NO: 784 - protein, 8 aa, Artificial Sequence
  Synthetic peptide
  misc_feature (4)..(4): Xaa is Serine or Phosphoserine
KRPXSEDF

SEQ ID NO: 785 - protein, 8 aa, Artificial Sequence
  Synthetic peptide
  misc_feature (3)..(3): Xaa is Serine or Phosphoserine
RPXSEDFV

SEQ ID NO: 786 - protein, 9 aa, Artificial Sequence
  Synthetic peptide
  misc_feature (6)..(6): Xaa is Serine or Phosphoserine
RAKRPXSED

SEQ ID NO: 787 - protein, 9 aa, Artificial Sequence
  Synthetic peptide
  misc_feature (5)..(5): Xaa is Serine or Phosphoserine
AKRPXSEDF

SEQ ID NO: 788 - protein, 9 aa, Artificial Sequence
  Synthetic peptide
  misc_feature (4)..(4): Xaa is Serine or Phosphoserine
KRPXSEDFV

SEQ ID NO: 789 - protein, 10 aa, Artificial Sequence
  Synthetic peptide
  misc_feature (6)..(6): Xaa is Serine or Phosphoserine
RAKRPXSEDF

SEQ ID NO: 790 - protein, 10 aa, Artificial Sequence
  Synthetic peptide
  misc_feature (5)..(5): Xaa is Serine or Phosphoserine
AKRPXSEDFV

SEQ ID NO: 791 - protein, 11 aa, Artificial Sequence
  Synthetic peptide
  misc_feature (6)..(6): Xaa is Serine or Phosphoserine
RAKRPXSEDFV

SEQ ID NO: 792 - protein, 5 aa, Artificial Sequence
  Synthetic peptide
  misc_feature (5)..(5): Xaa is Tyrosine or Phosphotyrosine
EAEPX

SEQ ID NO: 793 - protein, 5 aa, Artificial Sequence
  Synthetic peptide
  misc_feature (4)..(4): Xaa is Tyrosine or Phosphotyrosine
AEPXY

SEQ ID NO: 794 - protein, 5 aa, Artificial Sequence
  Synthetic peptide
  misc_feature (3)..(3): Xaa is Tyrosine or Phosphotyrosine
EPXYL

SEQ ID NO: 795 - protein, 5 aa, Artificial Sequence
  Synthetic peptide
  misc_feature (2)..(2): Xaa is Tyrosine or Phosphotyrosine
PXYLL

SEQ ID NO: 796 - protein, 5 aa, Artificial Sequence
  Synthetic peptide
  misc_feature (1)..(1): Xaa is Tyrosine or Phosphotyrosine
XYLLL

SEQ ID NO: 797 - protein, 6 aa, Artificial Sequence
  Synthetic peptide
  misc_feature (6)..(6): Xaa is Tyrosine or Phosphotyrosine
REAEPX

SEQ ID NO: 798 - protein, 6 aa, Artificial Sequence
  Synthetic peptide
  misc_feature (5)..(5): Xaa is Tyrosine or Phosphotyrosine
EAEPXY

SEQ ID NO: 799 - protein, 6 aa, Artificial Sequence
  Synthetic peptide
  misc_feature (4)..(4): Xaa is Tyrosine or Phosphotyrosine
AEPXYL

SEQ ID NO: 800 - protein, 6 aa, Artificial Sequence
  Synthetic peptide
  misc_feature (3)..(3): Xaa is Tyrosine or Phosphotyrosine
EPXYLL

SEQ ID NO: 801 - protein, 6 aa, Artificial Sequence
  Synthetic peptide
  misc_feature (2)..(2): Xaa is Tyrosine or Phosphotyrosine
PXYLLL

SEQ ID NO: 802 - protein, 6 aa, Artificial Sequence
  Synthetic peptide
  misc_feature (1)..(1): Xaa is Tyrosine or Phosphotyrosine
XYLLLP

SEQ ID NO: 803 - protein, 7 aa, Artificial Sequence
  Synthetic peptide
  misc_feature (6)..(6): Xaa is Tyrosine or Phosphotyrosine
REAEPXY

SEQ ID NO: 804 - protein, 7 aa, Artificial Sequence
  Synthetic peptide
  misc_feature (5)..(5): Xaa is Tyrosine or Phosphotyrosine
EAEPXYL

SEQ ID NO: 805 - protein, 7 aa, Artificial Sequence
  Synthetic peptide
  misc_feature (4)..(4): Xaa is Tyrosine or Phosphotyrosine
AEPXYLL

SEQ ID NO: 806 - protein, 7 aa, Artificial Sequence
  Synthetic peptide
  misc_feature (3)..(3): Xaa is Tyrosine or Phosphotyrosine
EPXYLLL

SEQ ID NO: 807 - protein, 7 aa, Artificial Sequence
  Synthetic peptide
  misc_feature (2)..(2): Xaa is Tyrosine or Phosphotyrosine
PXYLLLP

SEQ ID NO: 808 - protein, 8 aa, Artificial Sequence
  Synthetic peptide
  misc_feature (6)..(6): Xaa is Tyrosine or Phosphotyrosine
REAEPXYL

SEQ ID NO: 809 - protein, 8 aa, Artificial Sequence
  Synthetic peptide
  misc_feature (5)..(5): Xaa is Tyrosine or Phosphotyrosine
EAEPXYLL

SEQ ID NO: 810 - protein, 8 aa, Artificial Sequence
  Synthetic peptide
  misc_feature (4)..(4): Xaa is Tyrosine or Phosphotyrosine
AEPXYLLL

SEQ ID NO: 811 - protein, 8 aa, Artificial Sequence
  Synthetic peptide
  misc_feature (3)..(3): Xaa is Tyrosine or Phosphotyrosine
EPXYLLLP

SEQ ID NO: 812 - protein, 9 aa, Artificial Sequence
  Synthetic peptide
  misc_feature (6)..(6): Xaa is Tyrosine or Phosphotyrosine
REAEPXYLL

SEQ ID NO: 813 - protein, 9 aa, Artificial Sequence
  Synthetic peptide
  misc_feature (5)..(5): Xaa is Tyrosine or Phosphotyrosine
EAEPXYLLL

SEQ ID NO: 814 - protein, 9 aa, Artificial Sequence
  Synthetic peptide
  misc_feature (4)..(4): Xaa is Tyrosine or Phosphotyrosine
AEPXYLLLP

SEQ ID NO: 815 - protein, 10 aa, Artificial Sequence
  Synthetic peptide
  misc_feature (6)..(6): Xaa is Tyrosine or Phosphotyrosine
REAEPXYLLL

SEQ ID NO: 816 - protein, 10 aa, Artificial Sequence
  Synthetic peptide
  misc_feature (5)..(5): Xaa is Tyrosine or Phosphotyrosine
EAEPXYLLLP

SEQ ID NO: 817 - protein, 11 aa, Artificial Sequence
  Synthetic peptide
  misc_feature (6)..(6): Xaa is Tyrosine or Phosphotyrosine
REAEPXYLLLP

SEQ ID NO: 818 - protein, 5 aa, Artificial Sequence
  Synthetic peptide
  misc_feature (5)..(5): Xaa is Serine or Phosphoserine
EVCPX

SEQ ID NO: 819 - protein, 5 aa, Artificial Sequence
  Synthetic peptide
  misc_feature (4)..(4): Xaa is Serine or Phosphoserine
VCPXA

SEQ ID NO: 820 - protein, 5 aa, Artificial Sequence
  Synthetic peptide
  misc_feature (3)..(3): Xaa is Serine or Phosphoserine
CPXAI

SEQ ID NO: 821 - protein, 5 aa, Artificial Sequence
  Synthetic peptide
  misc_feature (2)..(2): Xaa is Serine or Phosphoserine
PXAID

SEQ ID NO: 822 - protein, 5 aa, Artificial Sequence
  Synthetic peptide
  misc_feature (1)..(1): Xaa is Serine or Phosphoserine
XAIDP

SEQ ID NO: 823 - protein, 6 aa, Artificial Sequence
  Synthetic peptide
  misc_feature (6)..(6): Xaa is Serine or Phosphoserine
KEVCPX

SEQ ID NO: 824 - protein, 6 aa, Artificial Sequence
  Synthetic peptide
  misc_feature (5)..(5): Xaa is Serine or Phosphoserine
EVCPXA

SEQ ID NO: 825 - protein, 6 aa, Artificial Sequence
  Synthetic peptide
  misc_feature (4)..(4): Xaa is Serine or Phosphoserine
VCPXAI

SEQ ID NO: 826 - protein, 6 aa, Artificial Sequence
  Synthetic peptide
  misc_feature (3)..(3): Xaa is Serine or Phosphoserine
CPXAID

SEQ ID NO: 827 - protein, 6 aa, Artificial Sequence
  Synthetic peptide
  misc_feature (2)..(2): Xaa is Serine or Phosphoserine
PXAIDP

SEQ ID NO: 828 - protein, 6 aa, Artificial Sequence
  Synthetic peptide
  misc_feature (1)..(1): Xaa is Serine or Phosphoserine
XAIDPE

SEQ ID NO: 829 - protein, 7 aa, Artificial Sequence
  Synthetic peptide
  misc_feature (6)..(6): Xaa is Serine or Phosphoserine
KEVCPXA

SEQ ID NO: 830 - protein, 7 aa, Artificial Sequence
  Synthetic peptide
  misc_feature (5)..(5): Xaa is Serine or Phosphoserine
EVCPXAI

SEQ ID NO: 831 - protein, 7 aa, Artificial Sequence
  Synthetic peptide
  misc_feature (4)..(4): Xaa is Serine or Phosphoserine
VCPXAID

SEQ ID NO: 832 - protein, 7 aa, Artificial Sequence
  Synthetic peptide
  misc_feature (3)..(3): Xaa is Serine or Phosphoserine
CPXAIDP

SEQ ID NO: 833 - protein, 7 aa, Artificial Sequence
  Synthetic peptide
  misc_feature (2)..(2): Xaa is Serine or Phosphoserine
PXAIDPE

SEQ ID NO: 834 - protein, 8 aa, Artificial Sequence
  Synthetic peptide
  misc_feature (6)..(6): Xaa is Serine or Phosphoserine
KEVCPXAI

SEQ ID NO: 835 - protein, 8 aa, Artificial Sequence
  Synthetic peptide
  misc_feature (5)..(5): Xaa is Serine or Phosphoserine
EVCPXAID

SEQ ID NO: 836 - protein, 8 aa, Artificial Sequence
  Synthetic peptide
  misc_feature (4)..(4): Xaa is Serine or Phosphoserine
VCPXAIDP

SEQ ID NO: 837 - protein, 8 aa, Artificial Sequence
  Synthetic peptide
  misc_feature (3)..(3): Xaa is Serine or Phosphoserine
CPXAIDPE

SEQ ID NO: 838 - protein, 9 aa, Artificial Sequence
  Synthetic peptide
  misc_feature (6)..(6): Xaa is Serine or Phosphoserine
KEVCPXAID

SEQ ID NO: 839 - protein, 9 aa, Artificial Sequence
  Synthetic peptide
  misc_feature (5)..(5): Xaa is Serine or Phosphoserine
EVCPXAIDP

SEQ ID NO: 840 - protein, 9 aa, Artificial Sequence
  Synthetic peptide
  misc_feature (4)..(4): Xaa is Serine or Phosphoserine
VCPXAIDPE

SEQ ID NO: 841 - protein, 10 aa, Artificial Sequence
  Synthetic peptide
  misc_feature (6)..(6): Xaa is Serine or Phosphoserine
KEVCPXAIDP

SEQ ID NO: 842 - protein, 10 aa, Artificial Sequence
  Synthetic peptide
  misc_feature (5)..(5): Xaa is Serine or Phosphoserine
EVCPXAIDPE

SEQ ID NO: 843 - protein, 11 aa, Artificial Sequence
  Synthetic peptide
  misc_feature (6)..(6): Xaa is Serine or Phosphoserine
KEVCPXAIDPE

SEQ ID NO: 844 - protein, 5 aa, Artificial Sequence
  Synthetic peptide
  misc_feature (5)..(5): Xaa is Serine or Phosphoserine
NTLEX

SEQ ID NO: 845 - protein, 5 aa, Artificial Sequence
  Synthetic peptide
  misc_feature (4)..(4): Xaa is Serine or Phosphoserine
TLEXF

SEQ ID NO: 846 - protein, 5 aa, Artificial Sequence
  Synthetic peptide
  misc_feature (3)..(3): Xaa is Serine or Phosphoserine
LEXFK

SEQ ID NO: 847 - protein, 5 aa, Artificial Sequence
  Synthetic peptide
  misc_feature (2)..(2): Xaa is Serine or Phosphoserine
EXFKT

SEQ ID NO: 848 - protein, 5 aa, Artificial Sequence
  Synthetic peptide
  misc_feature (1)..(1): Xaa is Serine or Phosphoserine
XFKTA

SEQ ID NO: 849 - protein, 6 aa, Artificial Sequence
  Synthetic peptide
  misc_feature (6)..(6): Xaa is Serine or Phosphoserine
TNTLEX

SEQ ID NO: 850 - protein, 6 aa, Artificial Sequence
  Synthetic peptide
  misc_feature (5)..(5): Xaa is Serine or Phosphoserine
NTLEXF

SEQ ID NO: 851 - protein, 6 aa, Artificial Sequence
  Synthetic peptide
  misc_feature (4)..(4): Xaa is Serine or Phosphoserine
TLEXFK

SEQ ID NO: 852 - protein, 6 aa, Artificial Sequence
  Synthetic peptide
  misc_feature (3)..(3): Xaa is Serine or Phosphoserine
LEXFKT

SEQ ID NO: 853 - protein, 6 aa, Artificial Sequence
  Synthetic peptide
  misc_feature (2)..(2): Xaa is Serine or Phosphoserine
EXFKTA

SEQ ID NO: 854 - protein, 6 aa, Artificial Sequence
  Synthetic peptide
  misc_feature (1)..(1): Xaa is Serine or Phosphoserine
XFKTAD

SEQ ID NO: 855 - protein, 7 aa, Artificial Sequence
  Synthetic peptide
  misc_feature (6)..(6): Xaa is Serine or Phosphoserine
TNTLEXF

SEQ ID NO: 856 - protein, 7 aa, Artificial Sequence
  Synthetic peptide
  misc_feature (5)..(5): Xaa is Serine or Phosphoserine
NTLEXFK

SEQ ID NO: 857 - protein, 7 aa, Artificial Sequence
  Synthetic peptide
  misc_feature (4)..(4): Xaa is Serine or Phosphoserine
TLEXFKT

SEQ ID NO: 858 - protein, 7 aa, Artificial Sequence
  Synthetic peptide
  misc_feature (3)..(3): Xaa is Serine or Phosphoserine
LEXFKTA

SEQ ID NO: 859 - protein, 7 aa, Artificial Sequence
  Synthetic peptide
  misc_feature (2)..(2): Xaa is Serine or Phosphoserine
EXFKTAD

SEQ ID NO: 860 - protein, 8 aa, Artificial Sequence
  Synthetic peptide
  misc_feature (6)..(6): Xaa is Serine or Phosphoserine
TNTLEXFK

SEQ ID NO: 861 - protein, 8 aa, Artificial Sequence
  Synthetic peptide
  misc_feature (5)..(5): Xaa is Serine or Phosphoserine
NTLEXFKT

SEQ ID NO: 862 - protein, 8 aa, Artificial Sequence
  Synthetic peptide
  misc_feature (4)..(4): Xaa is Serine or Phosphoserine
TLEXFKTA

SEQ ID NO: 863 - protein, 8 aa, Artificial Sequence
  Synthetic peptide
  misc_feature (3)..(3): Xaa is Serine or Phosphoserine
LEXFKTAD

SEQ ID NO: 864 - protein, 9 aa, Artificial Sequence
  Synthetic peptide
  misc_feature (6)..(6): Xaa is Serine or Phosphoserine
TNTLEXFKT

SEQ ID NO: 865 - protein, 9 aa, Artificial Sequence
  Synthetic peptide
  misc_feature (5)..(5): Xaa is Serine or Phosphoserine
NTLEXFKTA

SEQ ID NO: 866 - protein, 9 aa, Artificial Sequence
  Synthetic peptide
  misc_feature (4)..(4): Xaa is Serine or Phosphoserine
TLEXFKTAD

SEQ ID NO: 867 - protein, 10 aa, Artificial Sequence
  Synthetic peptide
  misc_feature (6)..(6): Xaa is Serine or Phosphoserine
TNTLEXFKTA

SEQ ID NO: 868 - protein, 10 aa, Artificial Sequence
  Synthetic peptide
  misc_feature (5)..(5): Xaa is Serine or Phosphoserine
NTLEXFKTAD

SEQ ID NO: 869 - protein, 11 aa, Artificial Sequence
  Synthetic peptide
  misc_feature (6)..(6): Xaa is Serine or Phosphoserine
TNTLEXFKTAD

SEQ ID NO: 870 - protein, 5 aa, Artificial Sequence
  Synthetic peptide
  misc_feature (5)..(5): Xaa is Serine or Phosphoserine
DQRFX

SEQ ID NO: 871 - protein, 5 aa, Artificial Sequence
  Synthetic peptide
  misc_feature (4)..(4): Xaa is Serine or Phosphoserine
QRFXL

SEQ ID NO: 872 - protein, 5 aa, Artificial Sequence
  Synthetic peptide
  misc_feature (3)..(3): Xaa is Serine or Phosphoserine
RFXLK

SEQ ID NO: 873 - protein, 5 aa, Artificial Sequence
  Synthetic peptide
  misc_feature (2)..(2): Xaa is Serine or Phosphoserine
FXLKQ

SEQ ID NO: 874 - protein, 5 aa, Artificial Sequence
  Synthetic peptide
  misc_feature (1)..(1): Xaa is Serine or Phosphoserine
XLKQI

SEQ ID NO: 875 - protein, 6 aa, Artificial Sequence
  Synthetic peptide
  misc_feature (6)..(6): Xaa is Serine or Phosphoserine
LDQRFX

SEQ ID NO: 876 - protein, 6 aa, Artificial Sequence
  Synthetic peptide
  misc_feature (5)..(5): Xaa is Serine or Phosphoserine
DQRFXL

SEQ ID NO: 877 - protein, 6 aa, Artificial Sequence
  Synthetic peptide
  misc_feature (4)..(4): Xaa is Serine or Phosphoserine
QRFXLK

SEQ ID NO: 878 - protein, 6 aa, Artificial Sequence
  Synthetic peptide
  misc_feature (3)..(3): Xaa is Serine or Phosphoserine
RFXLKQ

SEQ ID NO: 879 - protein, 6 aa, Artificial Sequence
  Synthetic peptide
  misc_feature (2)..(2): Xaa is Serine or Phosphoserine
FXLKQI

SEQ ID NO: 880 - protein, 6 aa, Artificial Sequence
  Synthetic peptide
  misc_feature (1)..(1): Xaa is Serine or Phosphoserine
XLKQIE

SEQ ID NO: 881 - protein, 7 aa, Artificial Sequence
  Synthetic peptide
  misc_feature (6)..(6): Xaa is Serine or Phosphoserine
LDQRFXL

SEQ ID NO: 882 - protein, 7 aa, Artificial Sequence
  Synthetic peptide
  misc_feature (5)..(5): Xaa is Serine or Phosphoserine
DQRFXLK

SEQ ID NO: 883 - protein, 7 aa, Artificial Sequence
  Synthetic peptide
  misc_feature (4)..(4): Xaa is Serine or Phosphoserine
QRFXLKQ

SEQ ID NO: 884 - protein, 7 aa, Artificial Sequence
  Synthetic peptide
  misc_feature (3)..(3): Xaa is Serine or Phosphoserine
RFXLKQI

SEQ ID NO: 885 - protein, 7 aa, Artificial Sequence
  Synthetic peptide
  misc_feature (2)..(2): Xaa is Serine or Phosphoserine
FXLKQIE

SEQ ID NO: 886 - protein, 8 aa, Artificial Sequence
  Synthetic peptide
  misc_feature (6)..(6): Xaa is Serine or Phosphoserine
LDQRFXLK

SEQ ID NO: 887 - protein, 8 aa, Artificial Sequence
  Synthetic peptide
  misc_feature (5)..(5): Xaa is Serine or Phosphoserine
DQRFXLKQ

SEQ ID NO: 888 - protein, 8 aa, Artificial Sequence
  Synthetic peptide
  misc_feature (4)..(4): Xaa is Serine or Phosphoserine
QRFXLKQI

SEQ ID NO: 889 - protein, 8 aa, Artificial Sequence
  Synthetic peptide
  misc_feature (3)..(3): Xaa is Serine or Phosphoserine
RFXLKQIE

SEQ ID NO: 890 - protein, 9 aa, Artificial Sequence
  Synthetic peptide
  misc_feature (6)..(6): Xaa is Serine or Phosphoserine
LDQRFXLKQ

SEQ ID NO: 891 - protein, 9 aa, Artificial Sequence
  Synthetic peptide
  misc_feature (5)..(5): Xaa is Serine or Phosphoserine
DQRFXLKQI

SEQ ID NO: 892 - protein, 9 aa, Artificial Sequence
  Synthetic peptide
  misc_feature (4)..(4): Xaa is Serine or Phosphoserine
QRFXLKQIE

SEQ ID NO: 893 - protein, 10 aa, Artificial Sequence
  Synthetic peptide
  misc_feature (6)..(6): Xaa is Serine or Phosphoserine
LDQRFXLKQI

SEQ ID NO: 894 - protein, 10 aa, Artificial Sequence
  Synthetic peptide
  misc_feature (5)..(5): Xaa is Serine or Phosphoserine
DQRFXLKQIE

SEQ ID NO: 895 - protein, 11 aa, Artificial Sequence
  Synthetic peptide
  misc_feature (6)..(6): Xaa is Serine or Phosphoserine
LDQRFXLKQIE

SEQ ID NO: 896 - protein, 5 aa, Artificial Sequence
  Synthetic peptide
  misc_feature (5)..(5): Xaa is Threonine or Phosphothreonine
KQRRX

SEQ ID NO: 897 - protein, 5 aa, Artificial Sequence
  Synthetic peptide
  misc_feature (4)..(4): Xaa is Threonine or Phosphothreonine
QRRXF

SEQ ID NO: 898 - protein, 5 aa, Artificial Sequence
  Synthetic peptide
  misc_feature (3)..(3): Xaa is Threonine or Phosphothreonine
RRXFE

SEQ ID NO: 899 - protein, 5 aa, Artificial Sequence
  Synthetic peptide
  misc_feature (2)..(2): Xaa is Threonine or Phosphothreonine
RXFEQ

SEQ ID NO: 900 - protein, 5 aa, Artificial Sequence
  Synthetic peptide
  misc_feature (1)..(1): Xaa is Threonine or Phosphothreonine
XFEQR

SEQ ID NO: 901 - protein, 6 aa, Artificial Sequence
  Synthetic peptide
  misc_feature (6)..(6): Xaa is Threonine or Phosphothreonine
FKQRRX

SEQ ID NO: 902 - protein, 6 aa, Artificial Sequence
  Synthetic peptide
  misc_feature (5)..(5): Xaa is Threonine or Phosphothreonine
KQRRXF

SEQ ID NO: 903 - protein, 6 aa, Artificial Sequence
  Synthetic peptide
  misc_feature (4)..(4): Xaa is Threonine or Phosphothreonine
QRRXFE

SEQ ID NO: 904 - protein, 6 aa, Artificial Sequence
  Synthetic peptide
  misc_feature (3)..(3): Xaa is Threonine or Phosphothreonine
RRXFEQ

SEQ ID NO: 905 - protein, 6 aa, Artificial Sequence
  Synthetic peptide
  misc_feature (2)..(2): Xaa is Threonine or Phosphothreonine
RXFEQR

SEQ ID NO: 906 - protein, 6 aa, Artificial Sequence
  Synthetic peptide
  misc_feature (1)..(1): Xaa is Threonine or Phosphothreonine
XFEQRV

SEQ ID NO: 907 - protein, 7 aa, Artificial Sequence
  Synthetic peptide
  misc_feature (7)..(7): Xaa is Threonine or Phosphothreonine
TFKQRRX

SEQ ID NO: 908 - protein, 7 aa, Artificial Sequence
  Synthetic peptide
  misc_feature (6)..(6): Xaa is Threonine or Phosphothreonine
FKQRRXF

SEQ ID NO: 909 - protein, 7 aa, Artificial Sequence
  Synthetic peptide
  misc_feature (5)..(5): Xaa is Threonine or Phosphothreonine
KQRRXFE

SEQ ID NO: 910 - protein, 7 aa, Artificial Sequence
  Synthetic peptide
  misc_feature (4)..(4): Xaa is Threonine or Phosphothreonine
QRRXFEQ

SEQ ID NO: 911 - protein, 7 aa, Artificial Sequence
  Synthetic peptide
  misc_feature (3)..(3): Xaa is Threonine or Phosphothreonine
RRXFEQR

SEQ ID NO: 912 - protein, 7 aa, Artificial Sequence
  Synthetic peptide
  misc_feature (2)..(2): Xaa is Threonine or Phosphothreonine
RXFEQRV

SEQ ID NO: 913 - protein, 8 aa, Artificial Sequence
  Synthetic peptide
  misc_feature (7)..(7): Xaa is Threonine or Phosphothreonine
TFKQRRXF

SEQ ID NO: 914 - protein, 8 aa, Artificial Sequence
  Synthetic peptide
  misc_feature (6)..(6): Xaa is Threonine or Phosphothreonine
FKQRRXFE

SEQ ID NO: 915 - protein, 8 aa, Artificial Sequence
  Synthetic peptide
  misc_feature (5)..(5): Xaa is Threonine or Phosphothreonine
KQRRXFEQ

SEQ ID NO: 916 - protein, 8 aa, Artificial Sequence
  Synthetic peptide
  misc_feature (4)..(4): Xaa is Threonine or Phosphothreonine
QRRXFEQR

SEQ ID NO: 917 - protein, 8 aa, Artificial Sequence
  Synthetic peptide
  misc_feature (3)..(3): Xaa is Threonine or Phosphothreonine
RRXFEQRV

SEQ ID NO: 918 - protein, 9 aa, Artificial Sequence
  Synthetic peptide
  misc_feature (7)..(7): Xaa is Threonine or Phosphothreonine
TFKQRRXFE

SEQ ID NO: 919 - protein, 9 aa, Artificial Sequence
  Synthetic peptide
  misc_feature (6)..(6): Xaa is Threonine or Phosphothreonine
FKQRRXFEQ

SEQ ID NO: 920 - protein, 9 aa, Artificial Sequence
  Synthetic peptide
  misc_feature (5)..(5): Xaa is Threonine or Phosphothreonine
KQRRXFEQR

SEQ ID NO: 921 - protein, 9 aa, Artificial Sequence
  Synthetic peptide
  misc_feature (4)..(4): Xaa is Threonine or Phosphothreonine
QRRXFEQRV

SEQ ID NO: 922 - protein, 10 aa, Artificial Sequence
  Synthetic peptide
  misc_feature (7)..(7): Xaa is Threonine or Phosphothreonine
TFKQRRXFEQ

SEQ ID NO: 923 - protein, 10 aa, Artificial Sequence
  Synthetic peptide
  misc_feature (6)..(6): Xaa is Threonine or Phosphothreonine
FKQRRXFEQR

SEQ ID NO: 924 - protein, 10 aa, Artificial Sequence
  Synthetic peptide
  misc_feature (5)..(5): Xaa is Threonine or Phosphothreonine
KQRRXFEQRV

SEQ ID NO: 925 - protein, 11 aa, Artificial Sequence
  Synthetic peptide
  misc_feature (7)..(7): Xaa is Threonine or Phosphothreonine
TFKQRRXFEQR

SEQ ID NO: 926 - protein, 11 aa, Artificial Sequence
  Synthetic peptide
  misc_feature (6)..(6): Xaa is Threonine or Phosphothreonine
FKQRRXFEQRV

SEQ ID NO: 927 - protein, 12 aa, Artificial Sequence
  Synthetic peptide
  misc_feature (7)..(7): Xaa is Threonine or Phosphothreonine
TFKQRRXFEQRV

SEQ ID NO: 928 - protein, 5 aa, Artificial Sequence
  Synthetic peptide
  misc_feature (5)..(5): Xaa is Serine or Phosphoserine
EVYEX

SEQ ID NO: 929 - protein, 5 aa, Artificial Sequence
  Synthetic peptide
  misc_feature (4)..(4): Xaa is Serine or Phosphoserine
VYEXE

SEQ ID NO: 930 - protein, 5 aa, Artificial Sequence
  Synthetic peptide
  misc_feature (3)..(3): Xaa is Serine or Phosphoserine
YEXEK

SEQ ID NO: 931 - protein, 5 aa, Artificial Sequence
  Synthetic peptide
  misc_feature (2)..(2): Xaa is Serine or Phosphoserine
EXEKD

SEQ ID NO: 932 - protein, 5 aa, Artificial Sequence
  Synthetic peptide
  misc_feature (1)..(1): Xaa is Serine or Phosphoserine
XEKDE

SEQ ID NO: 933 - protein, 6 aa, Artificial Sequence
  Synthetic peptide
  misc_feature (6)..(6): Xaa is Serine or Phosphoserine
SEVYEX

SEQ ID NO: 934 - protein, 6 aa, Artificial Sequence
  Synthetic peptide
  misc_feature (5)..(5): Xaa is Serine or Phosphoserine
EVYEXE

SEQ ID NO: 935 - protein, 6 aa, Artificial Sequence
  Synthetic peptide
  misc_feature (4)..(4): Xaa is Serine or Phosphoserine
VYEXEK

SEQ ID NO: 936 - protein, 6 aa, Artificial Sequence
  Synthetic peptide
  misc_feature (3)..(3): Xaa is Serine or Phosphoserine
YEXEKD

SEQ ID NO: 937 - protein, 6 aa, Artificial Sequence
  Synthetic peptide
  misc_feature (2)..(2): Xaa is Serine or Phosphoserine
EXEKDE

SEQ ID NO: 938 - protein, 6 aa, Artificial Sequence
  Synthetic peptide
  misc_feature (1)..(1): Xaa is Serine or Phosphoserine
XEKDED

SEQ ID NO: 939 - protein, 7 aa, Artificial Sequence
  Synthetic peptide
  misc_feature (6)..(6): Xaa is Serine or Phosphoserine
SEVYEXE

SEQ ID NO: 940 - protein, 7 aa, Artificial Sequence
  Synthetic peptide
  misc_feature (5)..(5): Xaa is Serine or Phosphoserine
EVYEXEK

SEQ ID NO: 941 - protein, 7 aa, Artificial Sequence
  Synthetic peptide
  misc_feature (4)..(4): Xaa is Serine or Phosphoserine
VYEXEKD

SEQ ID NO: 942 - protein, 7 aa, Artificial Sequence
  Synthetic peptide
  misc_feature (3)..(3): Xaa is Serine or Phosphoserine
YEXEKDE

SEQ ID NO: 943 - protein, 7 aa, Artificial Sequence
  Synthetic peptide
  misc_feature (2)..(2): Xaa is Serine or Phosphoserine
EXEKDED

SEQ ID NO: 944 - protein, 8 aa, Artificial Sequence
  Synthetic peptide
  misc_feature (6)..(6): Xaa is Serine or Phosphoserine
SEVYEXEK

SEQ ID NO: 945 - protein, 8 aa, Artificial Sequence
  Synthetic peptide
  misc_feature (5)..(5): Xaa is Serine or Phosphoserine
EVYEXEKD

SEQ ID NO: 946 - protein, 8 aa, Artificial Sequence
  Synthetic peptide
  misc_feature (4)..(4): Xaa is Serine or Phosphoserine
VYEXEKDE

SEQ ID NO: 947 - protein, 8 aa, Artificial Sequence
  Synthetic peptide
  misc_feature (3)..(3): Xaa is Serine or Phosphoserine
YEXEKDED

SEQ ID NO: 948 - protein, 9 aa, Artificial Sequence
  Synthetic peptide
  misc_feature (6)..(6): Xaa is Serine or Phosphoserine
SEVYEXEKD

SEQ ID NO: 949 - protein, 9 aa, Artificial Sequence
  Synthetic peptide
  misc_feature (5)..(5): Xaa is Serine or Phosphoserine
EVYEXEKDE

SEQ ID NO: 950 - protein, 9 aa, Artificial Sequence
  Synthetic peptide
  misc_feature (4)..(4): Xaa is Serine or Phosphoserine
VYEXEKDED

SEQ ID NO: 951 - protein, 10 aa, Artificial Sequence
  Synthetic peptide
  misc_feature (6)..(6): Xaa is Serine or Phosphoserine
SEVYEXEKDE

SEQ ID NO: 952 - protein, 10 aa, Artificial Sequence
  Synthetic peptide
  misc_feature (5)..(5): Xaa is Serine or Phosphoserine
EVYEXEKDED

SEQ ID NO: 953 - protein, 11 aa, Artificial Sequence
  Synthetic peptide
  misc_feature (6)..(6): Xaa is Serine or Phosphoserine
SEVYEXEKDED

SEQ ID NO: 954 - protein, 5 aa, Artificial Sequence
  Synthetic peptide
  misc_feature (5)..(5): Xaa is Serine or Phosphoserine
PRDGX

SEQ ID NO: 955 - protein, 5 aa, Artificial Sequence
  Synthetic peptide
  misc_feature (4)..(4): Xaa is Serine or Phosphoserine
RDGXS

SEQ ID NO: 956 - protein, 5 aa, Artificial Sequence
  Synthetic peptide
  misc_feature (3)..(3): Xaa is Serine or Phosphoserine
DGXSL

SEQ ID NO: 957 - protein, 5 aa, Artificial Sequence
  Synthetic peptide
  misc_feature (2)..(2): Xaa is Serine or Phosphoserine
GXSLE

SEQ ID NO: 958 - protein, 5 aa, Artificial Sequence
  Synthetic peptide
  misc_feature (1)..(1): Xaa is Serine or Phosphoserine
XSLED

SEQ ID NO: 959 - protein, 6 aa, Artificial Sequence
  Synthetic peptide
  misc_feature (5)..(5): Xaa is Serine or Phosphoserine
PRDGXS

SEQ ID NO: 960 - protein, 6 aa, Artificial Sequence
  Synthetic peptide
  misc_feature (4)..(4): Xaa is Serine or Phosphoserine
RDGXSL

SEQ ID NO: 961 - protein, 6 aa, Artificial Sequence
  Synthetic peptide
  misc_feature (3)..(3): Xaa is Serine or Phosphoserine
DGXSLE

SEQ ID NO: 962 - protein, 6 aa, Artificial Sequence
  Synthetic peptide
  misc_feature (2)..(2): Xaa is Serine or Phosphoserine
GXSLED

SEQ ID NO: 963 - protein, 6 aa, Artificial Sequence
  Synthetic peptide
  misc_feature (1)..(1): Xaa is Serine or Phosphoserine
XSLEDR

SEQ ID NO: 964 - protein, 7 aa, Artificial Sequence
  Synthetic peptide
  misc_feature (5)..(5): Xaa is Serine or Phosphoserine
PRDGXSL

SEQ ID NO: 965 - protein, 7 aa, Artificial Sequence
  Synthetic peptide
  misc_feature (4)..(4): Xaa is Serine or Phosphoserine
RDGXSLE

SEQ ID NO: 966 - protein, 7 aa, Artificial Sequence
  Synthetic peptide
  misc_feature (3)..(3): Xaa is Serine or Phosphoserine
DGXSLED

SEQ ID NO: 967 - protein, 7 aa, Artificial Sequence
  Synthetic peptide
  misc_feature (2)..(2): Xaa is Serine or Phosphoserine
GXSLEDR

SEQ ID NO: 968 - protein, 7 aa, Artificial Sequence
  Synthetic peptide
  misc_feature (1)..(1): Xaa is Serine or Phosphoserine
XSLEDRP

SEQ ID NO: 969 - protein, 8 aa, Artificial Sequence
  Synthetic peptide
  misc_feature (5)..(5): Xaa is Serine or Phosphoserine
PRDGXSLE

SEQ ID NO: 970 - protein, 8 aa, Artificial Sequence
  Synthetic peptide
  misc_feature (4)..(4): Xaa is Serine or Phosphoserine
RDGXSLED

SEQ ID NO: 971 - protein, 8 aa, Artificial Sequence
  Synthetic peptide
  misc_feature (3)..(3): Xaa is Serine or Phosphoserine
DGXSLEDR

SEQ ID NO: 972 - protein, 8 aa, Artificial Sequence
  Synthetic peptide
  misc_feature (2)..(2): Xaa is Serine or Phosphoserine
GXSLEDRP

SEQ ID NO: 973 - protein, 9 aa, Artificial Sequence
  Synthetic peptide
  misc_feature (5)..(5): Xaa is Serine or Phosphoserine
PRDGXSLED

SEQ ID NO: 974 - protein, 9 aa, Artificial Sequence
  Synthetic peptide
  misc_feature (4)..(4): Xaa is Serine or Phosphoserine
RDGXSLEDR

SEQ ID NO: 975 - protein, 9 aa, Artificial Sequence
  Synthetic peptide
  misc_feature (3)..(3): Xaa is Serine or Phosphoserine
DGXSLEDRP

SEQ ID NO: 976 - protein, 10 aa, Artificial Sequence
  Synthetic peptide
  misc_feature (5)..(5): Xaa is Serine or Phosphoserine
PRDGXSLEDR

SEQ ID NO: 977 - protein, 10 aa, Artificial Sequence
  Synthetic peptide
  misc_feature (4)..(4): Xaa is Serine or Phosphoserine
RDGXSLEDRP

SEQ ID NO: 978 - protein, 11 aa, Artificial Sequence
  Synthetic peptide
  misc_feature (5)..(5): Xaa is Serine or Phosphoserine
PRDGXSLEDRP

SEQ ID NO: 979 - protein, 6 aa, Artificial Sequence
  Synthetic peptide
  misc_feature (5)..(6): Xaa is Serine or Phosphoserine
PRDGXX

SEQ ID NO: 980 - protein, 6 aa, Artificial Sequence
  Synthetic peptide
  misc_feature (4)..(5): Xaa is Serine or Phosphoserine
RDGXXL

SEQ ID NO: 981 - protein, 6 aa, Artificial Sequence
  Synthetic peptide
  misc_feature (3)..(4): Xaa is Serine or Phosphoserine
DGXXLE

SEQ ID NO: 982 - protein, 6 aa, Artificial Sequence
  Synthetic peptide
  misc_feature (2)..(3): Xaa is Serine or Phosphoserine
GXXLED

SEQ ID NO: 983 - protein, 6 aa, Artificial Sequence
  Synthetic peptide
  misc_feature (1)..(2): Xaa is Serine or Phosphoserine
XXLEDR

SEQ ID NO: 984 - protein, 7 aa, Artificial Sequence
  Synthetic peptide
  misc_feature (5)..(6): Xaa is Serine or Phosphoserine
PRDGXXL

SEQ ID NO: 985 - protein, 7 aa, Artificial Sequence
  Synthetic peptide
  misc_feature (4)..(5): Xaa is Serine or Phosphoserine
RDGXXLE

SEQ ID NO: 986 - protein, 7 aa, Artificial Sequence
  Synthetic peptide
  misc_feature (3)..(4): Xaa is Serine or Phosphoserine
DGXXLED

SEQ ID NO: 987 - protein, 7 aa, Artificial Sequence
  Synthetic peptide
  misc_feature (2)..(3): Xaa is Serine or Phosphoserine
GXXLEDR

SEQ ID NO: 988 - protein, 7 aa, Artificial Sequence
  Synthetic peptide
  misc_feature (1)..(2): Xaa is Serine or Phosphoserine
XXLEDRP

SEQ ID NO: 989 - protein, 8 aa, Artificial Sequence
  Synthetic peptide
  misc_feature (5)..(6): Xaa is Serine or Phosphoserine
PRDGXXLE

SEQ ID NO: 990 - protein, 8 aa, Artificial Sequence
  Synthetic peptide
  misc_feature (4)..(5): Xaa is Serine or Phosphoserine
RDGXXLED

SEQ ID NO: 991 - protein, 8 aa, Artificial Sequence
  Synthetic peptide
  misc_feature (3)..(4): Xaa is Serine or Phosphoserine
DGXXLEDR

SEQ ID NO: 992 - protein, 8 aa, Artificial Sequence
  Synthetic peptide
  misc_feature (2)..(3): Xaa is Serine or Phosphoserine
GXXLEDRP

SEQ ID NO: 993 - protein, 7 aa, Artificial Sequence
  Synthetic peptide
  misc_feature (1)..(2): Xaa is Serine or Phosphoserine
XXLEDRP

SEQ ID NO: 994 - protein, 9 aa, Artificial Sequence
  Synthetic peptide
  misc_feature (5)..(6): Xaa is Serine or Phosphoserine
PRDGXXLED

SEQ ID NO: 995 - protein, 9 aa, Artificial Sequence
  Synthetic peptide
  misc_feature (4)..(5): Xaa is Serine or Phosphoserine
RDGXXLEDR

SEQ ID NO: 996 - protein, 9 aa, Artificial Sequence
  Synthetic peptide
  misc_feature (3)..(4): Xaa is Serine or Phosphoserine
DGXXLEDRP

SEQ ID NO: 997 - protein, 8 aa, Artificial Sequence
  Synthetic peptide
  misc_feature (2)..(3): Xaa is Serine or Phosphoserine
GXXLEDRP

SEQ ID NO: 998 - protein, 10 aa, Artificial Sequence
  Synthetic peptide
  misc_feature (5)..(6): Xaa is Serine or Phosphoserine
PRDGXXLEDR

SEQ ID NO: 999 - protein, 10 aa, Artificial Sequence
  Synthetic peptide
  misc_feature (4)..(5): Xaa is Serine or Phosphoserine
RDGXXLEDRP

SEQ ID NO: 1000 - protein, 9 aa, Artificial Sequence
  Synthetic peptide
  misc_feature (3)..(4): Xaa is Serine or Phosphoserine
DGXXLEDRP

SEQ ID NO: 1001 - protein, 11 aa, Artificial Sequence
  Synthetic peptide
  misc_feature (5)..(6): Xaa is Serine or Phosphoserine
PRDGXXLEDRP

SEQ ID NO: 1002 - protein, 5 aa, Artificial Sequence
  Synthetic peptide
  misc_feature (5)..(5): Xaa is Serine or Phosphoserine
RDGSX

SEQ ID NO: 1003 - protein, 5 aa, Artificial Sequence
  Synthetic peptide
  misc_feature (4)..(4): Xaa is Serine or Phosphoserine
DGSXL

SEQ ID NO: 1004 - protein, 5 aa, Artificial Sequence
  Synthetic peptide
  misc_feature (3)..(3): Xaa is Serine or Phosphoserine
GSXLE

SEQ ID NO: 1005 - protein, 5 aa, Artificial Sequence
  Synthetic peptide
  misc_feature (2)..(2): Xaa is Serine or Phosphoserine
SXLED

SEQ ID NO: 1006 - protein, 5 aa, Artificial Sequence
  Synthetic peptide
  misc_feature (1)..(1): Xaa is Serine or Phosphoserine
XLEDR

SEQ ID NO: 1007 - protein, 6 aa, Artificial Sequence
  Synthetic peptide
  misc_feature (6)..(6): Xaa is Serine or Phosphoserine
PRDGSX

SEQ ID NO: 1008 - protein, 6 aa, Artificial Sequence
  Synthetic peptide
  misc_feature (5)..(5): Xaa is Serine or Phosphoserine
RDGSXL

SEQ ID NO: 1009 - protein, 6 aa, Artificial Sequence
  Synthetic peptide
  misc_feature (4)..(4): Xaa is Serine or Phosphoserine
DGSXLE

SEQ ID NO: 1010 - protein, 6 aa, Artificial Sequence
  Synthetic peptide
  misc_feature (3)..(3): Xaa is Serine or Phosphoserine
GSXLED

SEQ ID NO: 1011 - protein, 6 aa, Artificial Sequence
  Synthetic peptide
  misc_feature (2)..(2): Xaa is Serine or Phosphoserine
SXLEDR

SEQ ID NO: 1012 - protein, 6 aa, Artificial Sequence
  Synthetic peptide
  misc_feature (1)..(1): Xaa is Serine or Phosphoserine
XLEDRP

SEQ ID NO: 1013 - protein, 7 aa, Artificial Sequence
  Synthetic peptide
  misc_feature (6)..(6): Xaa is Serine or Phosphoserine
PRDGSXL

SEQ ID NO: 1014 - protein, 7 aa, Artificial Sequence
  Synthetic peptide
  misc_feature (5)..(5): Xaa is Serine or Phosphoserine
RDGSXLE

SEQ ID NO: 1015 - protein, 7 aa, Artificial Sequence
  Synthetic peptide
  misc_feature (4)..(4): Xaa is Serine or Phosphoserine
DGSXLED

SEQ ID NO: 1016 - protein, 7 aa, Artificial Sequence
  Synthetic peptide
  misc_feature (3)..(3): Xaa is Serine or Phosphoserine
GSXLEDR

SEQ ID NO: 1017 - protein, 7 aa, Artificial Sequence
  Synthetic peptide
  misc_feature (2)..(2): Xaa is Serine or Phosphoserine
SXLEDRP

SEQ ID NO: 1018 - protein, 8 aa, Artificial Sequence
  Synthetic peptide
  misc_feature (6)..(6): Xaa is Serine or Phosphoserine
PRDGSXLE

SEQ ID NO: 1019 - protein, 8 aa, Artificial Sequence
  Synthetic peptide
  misc_feature (5)..(5): Xaa is Serine or Phosphoserine
RDGSXLED

SEQ ID NO: 1020 - protein, 8 aa, Artificial Sequence
  Synthetic peptide
  misc_feature (4)..(4): Xaa is Serine or Phosphoserine
DGSXLEDR

SEQ ID NO: 1021 - protein, 8 aa, Artificial Sequence
  Synthetic peptide
  misc_feature (3)..(3): Xaa is Serine or Phosphoserine
GSXLEDRP

SEQ ID NO: 1022 - protein, 9 aa, Artificial Sequence
  Synthetic peptide
  misc_feature (6)..(6): Xaa is Serine or Phosphoserine
PRDGSXLED

SEQ ID NO: 1023 - protein, 9 aa, Artificial Sequence
  Synthetic peptide
  misc_feature (5)..(5): Xaa is Serine or Phosphoserine
RDGSXLEDR

SEQ ID NO: 1024 - protein, 9 aa, Artificial Sequence
  Synthetic peptide
  misc_feature (4)..(4): Xaa is Serine or Phosphoserine
DGSXLEDRP

SEQ ID NO: 1025 - protein, 10 aa, Artificial Sequence
  Synthetic peptide
  misc_feature (6)..(6): Xaa is Serine or Phosphoserine
PRDGSXLEDR

SEQ ID NO: 1026 - protein, 10 aa, Artificial Sequence
  Synthetic peptide
  misc_feature (5)..(5): Xaa is Serine or Phosphoserine
RDGSXLEDRP

SEQ ID NO: 1027 - protein, 11 aa, Artificial Sequence
  Synthetic peptide
  misc_feature (6)..(6): Xaa is Serine or Phosphoserine
PRDGSXLEDRP

SEQ ID NO: 1028 - protein, 5 aa, Artificial Sequence
  Synthetic peptide
  misc_feature (5)..(5): Xaa is Serine or Phosphoserine
RLEAX

SEQ ID NO: 1029 - protein, 5 aa, Artificial Sequence
  Synthetic peptide
  misc_feature (4)..(4): Xaa is Serine or Phosphoserine
LEAXY

SEQ ID NO: 1030 - protein, 5 aa, Artificial Sequence
  Synthetic peptide
  misc_feature (3)..(3): Xaa is Serine or Phosphoserine
EAXYS

SEQ ID NO: 1031 - protein, 5 aa, Artificial Sequence
  Synthetic peptide
  misc_feature (2)..(2): Xaa is Serine or Phosphoserine
AXYSD

SEQ ID NO: 1032 - protein, 5 aa, Artificial Sequence
  Synthetic peptide
  misc_feature (1)..(1): Xaa is Serine or Phosphoserine
XYSDS

SEQ ID NO: 1033 - protein, 6 aa, Artificial Sequence
  Synthetic peptide
  misc_feature (6)..(6): Xaa is Serine or Phosphoserine
QRLEAX

SEQ ID NO: 1034 - protein, 6 aa, Artificial Sequence
  Synthetic peptide
  misc_feature (5)..(5): Xaa is Serine or Phosphoserine
RLEAXY

SEQ ID NO: 1035 - protein, 6 aa, Artificial Sequence
  Synthetic peptide
  misc_feature (4)..(4): Xaa is Serine or Phosphoserine
LEAXYS

SEQ ID NO: 1036 - protein, 6 aa, Artificial Sequence
  Synthetic peptide
  misc_feature (3)..(3): Xaa is Serine or Phosphoserine
EAXYSD

SEQ ID NO: 1037 - protein, 6 aa, Artificial Sequence
  Synthetic peptide
  misc_feature (2)..(2): Xaa is Serine or Phosphoserine
AXYSDS

SEQ ID NO: 1038 - protein, 6 aa, Artificial Sequence
  Synthetic peptide
  misc_feature (1)..(1): Xaa is Serine or Phosphoserine
XYSDSP

SEQ ID NO: 1039 - protein, 7 aa, Artificial Sequence
  Synthetic peptide
  misc_feature (6)..(6): Xaa is Serine or Phosphoserine
QRLEAXY

SEQ ID NO: 1040 - protein, 7 aa, Artificial Sequence
  Synthetic peptide
  misc_feature (5)..(5): Xaa is Serine or Phosphoserine
RLEAXYS

SEQ ID NO: 1041 - protein, 7 aa, Artificial Sequence
  Synthetic peptide
  misc_feature (4)..(4): Xaa is Serine or Phosphoserine
LEAXYSD

SEQ ID NO: 1042 - protein, 7 aa, Artificial Sequence
  Synthetic peptide
  misc_feature (3)..(3): Xaa is Serine or Phosphoserine
EAXYSDS

SEQ ID NO: 1043 - protein, 7 aa, Artificial Sequence
  Synthetic peptide
  misc_feature (2)..(2): Xaa is Serine or Phosphoserine
AXYSDSP

SEQ ID NO: 1044 - protein, 8 aa, Artificial Sequence
  Synthetic peptide
  misc_feature (6)..(6): Xaa is Serine or Phosphoserine
QRLEAXYS

SEQ ID NO: 1045 - protein, 8 aa, Artificial Sequence
  Synthetic peptide
  misc_feature (5)..(5): Xaa is Serine or Phosphoserine
RLEAXYSD

SEQ ID NO: 1046 - protein, 8 aa, Artificial Sequence
  Synthetic peptide
  misc_feature (4)..(4): Xaa is Serine or Phosphoserine
LEAXYSDS

SEQ ID NO: 1047 - protein, 8 aa, Artificial Sequence
  Synthetic peptide
  misc_feature (3)..(3): Xaa is Serine or Phosphoserine
EAXYSDSP

SEQ ID NO: 1048 - protein, 9 aa, Artificial Sequence
  Synthetic peptide
  misc_feature (6)..(6): Xaa is Serine or Phosphoserine
QRLEAXYSD

SEQ ID NO: 1049 - protein, 9 aa, Artificial Sequence
  Synthetic peptide
  misc_feature (5)..(5): Xaa is Serine or Phosphoserine
RLEAXYSDS

SEQ ID NO: 1050 - protein, 9 aa, Artificial Sequence
  Synthetic peptide
  misc_feature (4)..(4): Xaa is Serine or Phosphoserine
LEAXYSDSP

SEQ ID NO: 1051 - protein, 10 aa, Artificial Sequence
  Synthetic peptide
  misc_feature (6)..(6): Xaa is Serine or Phosphoserine
QRLEAXYSDS

SEQ ID NO: 1052 - protein, 10 aa, Artificial Sequence
  Synthetic peptide
  misc_feature (5)..(5): Xaa is Serine or Phosphoserine
RLEAXYSDSP

SEQ ID NO: 1053 - protein, 11 aa, Artificial Sequence
  Synthetic peptide
  misc_feature (6)..(6): Xaa is Serine or Phosphoserine
QRLEAXYSDSP

SEQ ID NO: 1054 - protein, 5 aa, Artificial Sequence
  Synthetic peptide
  misc_feature (5)..(5): Xaa is Tyrosine or Phosphotyrosine
ELDIX

SEQ ID NO: 1055 - protein, 5 aa, Artificial Sequence
  Synthetic peptide
  misc_feature (4)..(4): Xaa is Tyrosine or Phosphotyrosine
LDIXH

SEQ ID NO: 1056 - protein, 5 aa, Artificial Sequence
  Synthetic peptide
  misc_feature (3)..(3): Xaa is Tyrosine or Phosphotyrosine
DIXHR

SEQ ID NO: 1057 - protein, 5 aa, Artificial Sequence
  Synthetic peptide
  misc_feature (2)..(2): Xaa is Tyrosine or Phosphotyrosine
IXHRI

SEQ ID NO: 1058 - protein, 5 aa, Artificial Sequence
  Synthetic peptide
  misc_feature (1)..(1): Xaa is Tyrosine or Phosphotyrosine
XHRIL

SEQ ID NO: 1059 - protein, 6 aa, Artificial Sequence
  Synthetic peptide
  misc_feature (6)..(6): Xaa is Tyrosine or Phosphotyrosine
TELDIX

SEQ ID NO: 1060 - protein, 6 aa, Artificial Sequence
  Synthetic peptide
  misc_feature (5)..(5): Xaa is Tyrosine or Phosphotyrosine
ELDIXH

SEQ ID NO: 1061 - protein, 6 aa, Artificial Sequence
  Synthetic peptide
  misc_feature (4)..(4): Xaa is Tyrosine or Phosphotyrosine
LDIXHR

SEQ ID NO: 1062 - protein, 6 aa, Artificial Sequence
  Synthetic peptide
  misc_feature (3)..(3): Xaa is Tyrosine or Phosphotyrosine
DIXHRI

SEQ ID NO: 1063 - protein, 6 aa, Artificial Sequence
  Synthetic peptide
  misc_feature (2)..(2): Xaa is Tyrosine or Phosphotyrosine
IXHRIL

SEQ ID NO: 1064 - protein, 6 aa, Artificial Sequence
  Synthetic peptide
  misc_feature (1)..(1): Xaa is Tyrosine or Phosphotyrosine
XHRILR

SEQ ID NO: 1065 - protein, 7 aa, Artificial Sequence
  Synthetic peptide
  misc_feature (6)..(6): Xaa is Tyrosine or Phosphotyrosine
TELDIXH

SEQ ID NO: 1066 - protein, 7 aa, Artificial Sequence
  Synthetic peptide
  misc_feature (5)..(5): Xaa is Tyrosine or Phosphotyrosine
ELDIXHR

SEQ ID NO: 1067 - protein, 7 aa, Artificial Sequence
  Synthetic peptide
  misc_feature (4)..(4): Xaa is Tyrosine or Phosphotyrosine
LDIXHRI

SEQ ID NO: 1068 - protein, 7 aa, Artificial Sequence
  Synthetic peptide
  misc_feature (3)..(3): Xaa is Tyrosine or Phosphotyrosine
DIXHRIL

SEQ ID NO: 1069 - protein, 7 aa, Artificial Sequence
  Synthetic peptide
  misc_feature (2)..(2): Xaa is Tyrosine or Phosphotyrosine
IXHRILR

SEQ ID NO: 1070 - protein, 8 aa, Artificial Sequence
  Synthetic peptide
  misc_feature (6)..(6): Xaa is Tyrosine or Phosphotyrosine
TELDIXHR

SEQ ID NO: 1071 - protein, 8 aa, Artificial Sequence
  Synthetic peptide
  misc_feature (5)..(5): Xaa is Tyrosine or Phosphotyrosine
ELDIXHRI

SEQ ID NO: 1072 - protein, 8 aa, Artificial Sequence
  Synthetic peptide
  misc_feature (4)..(4): Xaa is Tyrosine or Phosphotyrosine
LDIXHRIL

SEQ ID NO: 1073 - protein, 8 aa, Artificial Sequence
  Synthetic peptide
  misc_feature (3)..(3): Xaa is Tyrosine or Phosphotyrosine
DIXHRILR

SEQ ID NO: 1074 - protein, 9 aa, Artificial Sequence
  Synthetic peptide
  misc_feature (6)..(6): Xaa is Tyrosine or Phosphotyrosine
TELDIXHRI

SEQ ID NO: 1075 - protein, 9 aa, Artificial Sequence
  Synthetic peptide
  misc_feature (5)..(5): Xaa is Tyrosine or Phosphotyrosine
ELDIXHRIL

SEQ ID NO: 1076 - protein, 9 aa, Artificial Sequence
  Synthetic peptide
  misc_feature (4)..(4): Xaa is Tyrosine or Phosphotyrosine
LDIXHRILR

SEQ ID NO: 1077 - protein, 10 aa, Artificial Sequence
  Synthetic peptide
  misc_feature (6)..(6): Xaa is Tyrosine or Phosphotyrosine
TELDIXHRIL

SEQ ID NO: 1078 - protein, 10 aa, Artificial Sequence
  Synthetic peptide
  misc_feature (5)..(5): Xaa is Tyrosine or Phosphotyrosine
ELDIXHRILR

SEQ ID NO: 1079 - protein, 11 aa, Artificial Sequence
  Synthetic peptide
  misc_feature (6)..(6): Xaa is Tyrosine or Phosphotyrosine
TELDIXHRILR

SEQ ID NO: 1080 - protein, 5 aa, Artificial Sequence
  Synthetic peptide
  misc_feature (5)..(5): Xaa is Serine or Phosphoserine
QSLQX

SEQ ID NO: 1081 - protein, 5 aa, Artificial Sequence
  Synthetic peptide
  misc_feature (4)..(4): Xaa is Serine or Phosphoserine
SLQXE

SEQ ID NO: 1082 - protein, 5 aa, Artificial Sequence
  Synthetic peptide
  misc_feature (3)..(3): Xaa is Serine or Phosphoserine
LQXES

SEQ ID NO: 1083 - protein, 5 aa, Artificial Sequence
  Synthetic peptide
  misc_feature (2)..(2): Xaa is Serine or Phosphoserine
QXESE

SEQ ID NO: 1084 - protein, 5 aa, Artificial Sequence
  Synthetic peptide
  misc_feature (1)..(1): Xaa is Serine or Phosphoserine
XESEP

SEQ ID NO: 1085 - protein, 6 aa, Artificial Sequence
  Synthetic peptide
  misc_feature (6)..(6): Xaa is Serine or Phosphoserine
IQSLQX

SEQ ID NO: 1086 - protein, 6 aa, Artificial Sequence
  Synthetic peptide
  misc_feature (5)..(5): Xaa is Serine or Phosphoserine
QSLQXE

SEQ ID NO: 1087 - protein, 6 aa, Artificial Sequence
  Synthetic peptide
  misc_feature (4)..(4): Xaa is Serine or Phosphoserine
SLQXES

SEQ ID NO: 1088 - protein, 6 aa, Artificial Sequence
  Synthetic peptide
  misc_feature (3)..(3): Xaa is Serine or Phosphoserine
LQXESE

SEQ ID NO: 1089 - protein, 6 aa, Artificial Sequence
  Synthetic peptide
  misc_feature (2)..(2): Xaa is Serine or Phosphoserine
QXESEP

SEQ ID NO: 1090 - protein, 6 aa, Artificial Sequence
  Synthetic peptide
  misc_feature (1)..(1): Xaa is Serine or Phosphoserine
XESEPL

SEQ ID NO: 1091 - protein, 7 aa, Artificial Sequence
  Synthetic peptide
  misc_feature (6)..(6): Xaa is Serine or Phosphoserine
IQSLQXE

SEQ ID NO: 1092 - protein, 7 aa, Artificial Sequence
  Synthetic peptide
  misc_feature (5)..(5): Xaa is Serine or Phosphoserine
QSLQXES

SEQ ID NO: 1093 - protein, 7 aa, Artificial Sequence
  Synthetic peptide
  misc_feature (4)..(4): Xaa is Serine or Phosphoserine
SLQXESE

SEQ ID NO: 1094 - protein, 7 aa, Artificial Sequence
  Synthetic peptide
  misc_feature (3)..(3): Xaa is Serine or Phosphoserine
LQXESEP

SEQ ID NO: 1095 - protein, 7 aa, Artificial Sequence
  Synthetic peptide
  misc_feature (2)..(2): Xaa is Serine or Phosphoserine
QXESEPL

SEQ ID NO: 1096 - protein, 8 aa, Artificial Sequence
  Synthetic peptide
  misc_feature (6)..(6): Xaa is Serine or Phosphoserine
IQSLQXES

SEQ ID NO: 1097 - protein, 8 aa, Artificial Sequence
  Synthetic peptide
  misc_feature (5)..(5): Xaa is Serine or Phosphoserine
QSLQXESE

SEQ ID NO: 1098 - protein, 8 aa, Artificial Sequence
  Synthetic peptide
  misc_feature (4)..(4): Xaa is Serine or Phosphoserine
SLQXESEP

SEQ ID NO: 1099 - protein, 8 aa, Artificial Sequence
  Synthetic peptide
  misc_feature (3)..(3): Xaa is Serine or Phosphoserine
LQXESEPL

SEQ ID NO: 1100 - protein, 9 aa, Artificial Sequence
  Synthetic peptide
  misc_feature (6)..(6): Xaa is Serine or Phosphoserine
IQSLQXESE

SEQ ID NO: 1101 - protein, 9 aa, Artificial Sequence
  Synthetic peptide
  misc_feature (5)..(5): Xaa is Serine or Phosphoserine
QSLQXESEP

SEQ ID NO: 1102 - protein, 9 aa, Artificial Sequence
  Synthetic peptide
  misc_feature (4)..(4): Xaa is Serine or Phosphoserine
SLQXESEPL

SEQ ID NO: 1103 - protein, 10 aa, Artificial Sequence
  Synthetic peptide
  misc_feature (6)..(6): Xaa is Serine or Phosphoserine
IQSLQXESEP

SEQ ID NO: 1104 - protein, 10 aa, Artificial Sequence
  Synthetic peptide
  misc_feature (5)..(5): Xaa is Serine or Phosphoserine
QSLQXESEPL

SEQ ID NO: 1105 - protein, 11 aa, Artificial Sequence
  Synthetic peptide
  misc_feature (6)..(6): Xaa is Serine or Phosphoserine
IQSLQXESEPL

SEQ ID NO: 1106 - protein, 5 aa, Artificial Sequence
  Synthetic peptide
  misc_feature (5)..(5): Xaa is Serine or Phosphoserine
HRREX

SEQ ID NO: 1107 - protein, 5 aa, Artificial Sequence
  Synthetic peptide
  misc_feature (4)..(4): Xaa is Serine or Phosphoserine
RREXD

SEQ ID NO: 1108 - protein, 5 aa, Artificial Sequence
  Synthetic peptide
  misc_feature (3)..(3): Xaa is Serine or Phosphoserine
REXDE

SEQ ID NO: 1109 - protein, 5 aa, Artificial Sequence
  Synthetic peptide
  misc_feature (2)..(2): Xaa is Serine or Phosphoserine
EXDES

SEQ ID NO: 1110 - protein, 5 aa, Artificial Sequence
  Synthetic peptide
  misc_feature (1)..(1): Xaa is Serine or Phosphoserine
XDESG

SEQ ID NO: 1111 - protein, 6 aa, Artificial Sequence
  Synthetic peptide
  misc_feature (6)..(6): Xaa is Serine or Phosphoserine
WHRREX

SEQ ID NO: 1112 - protein, 6 aa, Artificial Sequence
  Synthetic peptide
  misc_feature (5)..(5): Xaa is Serine or Phosphoserine
HRREXD

SEQ ID NO: 1113 - protein, 6 aa, Artificial Sequence
  Synthetic peptide
  misc_feature (4)..(4): Xaa is Serine or Phosphoserine
RREXDE

SEQ ID NO: 1114 - protein, 6 aa, Artificial Sequence
  Synthetic peptide
  misc_feature (3)..(3): Xaa is Serine or Phosphoserine
REXDES

SEQ ID NO: 1115 - protein, 6 aa, Artificial Sequence
  Synthetic peptide
  misc_feature (2)..(2): Xaa is Serine or Phosphoserine
EXDESG

SEQ ID NO: 1116 - protein, 6 aa, Artificial Sequence
  Synthetic peptide
  misc_feature (1)..(1): Xaa is Serine or Phosphoserine
XDESGE

SEQ ID NO: 1117 - protein, 7 aa, Artificial Sequence
  Synthetic peptide
  misc_feature (6)..(6): Xaa is Serine or Phosphoserine
WHRREXD

SEQ ID NO: 1118 - protein, 7 aa, Artificial Sequence
  Synthetic peptide
  misc_feature (5)..(5): Xaa is Serine or Phosphoserine
HRREXDE

SEQ ID NO: 1119 - protein, 7 aa, Artificial Sequence
  Synthetic peptide
  misc_feature (4)..(4): Xaa is Serine or Phosphoserine
RREXDES

SEQ ID NO: 1120 - protein, 7 aa, Artificial Sequence
  Synthetic peptide
  misc_feature (3)..(3): Xaa is Serine or Phosphoserine
REXDESG

SEQ ID NO: 1121 - protein, 7 aa, Artificial Sequence
  Synthetic peptide
  misc_feature (2)..(2): Xaa is Serine or Phosphoserine
EXDESGE

SEQ ID NO: 1122 - protein, 8 aa, Artificial Sequence
  Synthetic peptide
  misc_feature (6)..(6): Xaa is Serine or Phosphoserine
WHRREXDE

SEQ ID NO: 1123 - protein, 8 aa, Artificial Sequence
  Synthetic peptide
  misc_feature (5)..(5): Xaa is Serine or Phosphoserine
HRREXDES

SEQ ID NO: 1124 - protein, 8 aa, Artificial Sequence
  Synthetic peptide
  misc_feature (4)..(4): Xaa is Serine or Phosphoserine
RREXDESG

SEQ ID NO: 1125 - protein, 8 aa, Artificial Sequence
  Synthetic peptide
  misc_feature (3)..(3): Xaa is Serine or Phosphoserine
REXDESGE

SEQ ID NO: 1126 - protein, 9 aa, Artificial Sequence
  Synthetic peptide
  misc_feature (6)..(6): Xaa is Serine or Phosphoserine
WHRREXDES

SEQ ID NO: 1127 - protein, 9 aa, Artificial Sequence
  Synthetic peptide
  misc_feature (5)..(5): Xaa is Serine or Phosphoserine
HRREXDESG

SEQ ID NO: 1128 - protein, 9 aa, Artificial Sequence
  Synthetic peptide
  misc_feature (4)..(4): Xaa is Serine or Phosphoserine
RREXDESGE

SEQ ID NO: 1129 - protein, 10 aa, Artificial Sequence
  Synthetic peptide
  misc_feature (6)..(6): Xaa is Serine or Phosphoserine
WHRREXDESG

SEQ ID NO: 1130 - protein, 10 aa, Artificial Sequence
  Synthetic peptide
  misc_feature (5)..(5): Xaa is Serine or Phosphoserine
HRREXDESGE

SEQ ID NO: 1131 - protein, 11 aa, Artificial Sequence
  Synthetic peptide
  misc_feature (6)..(6): Xaa is Serine or Phosphoserine
WHRREXDESGE

SEQ ID NO: 1132 - protein, 5 aa, Artificial Sequence
  Synthetic peptide
  misc_feature (5)..(5): Xaa is Serine or Phosphoserine
ESDEX

SEQ ID NO: 1133 - protein, 5 aa, Artificial Sequence
  Synthetic peptide
  misc_feature (4)..(4): Xaa is Serine or Phosphoserine
SDEXG

SEQ ID NO: 1134 - protein, 5 aa, Artificial Sequence
  Synthetic peptide
  misc_feature (3)..(3): Xaa is Serine or Phosphoserine
DEXGE

SEQ ID NO: 1135 - protein, 5 aa, Artificial Sequence
  Synthetic peptide
  misc_feature (2)..(2): Xaa is Serine or Phosphoserine
EXGES

SEQ ID NO: 1136 - protein, 5 aa, Artificial Sequence
  Synthetic peptide
  misc_feature (1)..(1): Xaa is Serine or Phosphoserine
XGESA

SEQ ID NO: 1137 - protein, 6 aa, Artificial Sequence
  Synthetic peptide
  misc_feature (6)..(6): Xaa is Serine or Phosphoserine
RESDEX

SEQ ID NO: 1138 - protein, 6 aa, Artificial Sequence
  Synthetic peptide
  misc_feature (5)..(5): Xaa is Serine or Phosphoserine
ESDEXG

SEQ ID NO: 1139 - protein, 6 aa, Artificial Sequence
  Synthetic peptide
  misc_feature (4)..(4): Xaa is Serine or Phosphoserine
SDEXGE

SEQ ID NO: 1140 - protein, 6 aa, Artificial Sequence
  Synthetic peptide
  misc_feature (3)..(3): Xaa is Serine or Phosphoserine
DEXGES

SEQ ID NO: 1141 - protein, 6 aa, Artificial Sequence
  Synthetic peptide
  misc_feature (2)..(2): Xaa is Serine or Phosphoserine
EXGESA

SEQ ID NO: 1142 - protein, 6 aa, Artificial Sequence
  Synthetic peptide
  misc_feature (1)..(1): Xaa is Serine or Phosphoserine
XGESAP

SEQ ID NO: 1143 - protein, 7 aa, Artificial Sequence
  Synthetic peptide
  misc_feature (6)..(6): Xaa is Serine or Phosphoserine
RESDEXG

SEQ ID NO: 1144 - protein, 7 aa, Artificial Sequence
  Synthetic peptide
  misc_feature (5)..(5): Xaa is Serine or Phosphoserine
ESDEXGE

SEQ ID NO: 1145 - protein, 7 aa, Artificial Sequence
  Synthetic peptide
  misc_feature (4)..(4): Xaa is Serine or Phosphoserine
SDEXGES

SEQ ID NO: 1146 - protein, 7 aa, Artificial Sequence
  Synthetic peptide
  misc_feature (3)..(3): Xaa is Serine or Phosphoserine
DEXGESA

SEQ ID NO: 1147 - protein, 7 aa, Artificial Sequence
  Synthetic peptide
  misc_feature (2)..(2): Xaa is Serine or Phosphoserine
EXGESAP

SEQ ID NO: 1148 - protein, 8 aa, Artificial Sequence
  Synthetic peptide
  misc_feature (6)..(6): Xaa is Serine or Phosphoserine
RESDEXGE

SEQ ID NO: 1149 - protein, 8 aa, Artificial Sequence
  Synthetic peptide
  misc_feature (5)..(5): Xaa is Serine or Phosphoserine
ESDEXGES

SEQ ID NO: 1150 - protein, 8 aa, Artificial Sequence
  Synthetic peptide
  misc_feature (4)..(4): Xaa is Serine or Phosphoserine
SDEXGESA

SEQ ID NO: 1151 - protein, 8 aa, Artificial Sequence
  Synthetic peptide
  misc_feature (3)..(3): Xaa is Serine or Phosphoserine
DEXGESAP

SEQ ID NO: 1152 - protein, 9 aa, Artificial Sequence
  Synthetic peptide
  misc_feature (6)..(6): Xaa is Serine or Phosphoserine
RESDEXGES

SEQ ID NO: 1153 - protein, 9 aa, Artificial Sequence
  Synthetic peptide
  misc_feature (5)..(5): Xaa is Serine or Phosphoserine
ESDEXGESA

SEQ ID NO: 1154 - protein, 9 aa, Artificial Sequence
  Synthetic peptide
  misc_feature (4)..(4): Xaa is Serine or Phosphoserine
SDEXGESAP

SEQ ID NO: 1155 - protein, 10 aa, Artificial Sequence
  Synthetic peptide
  misc_feature (6)..(6): Xaa is Serine or Phosphoserine
RESDEXGESA

SEQ ID NO: 1156 - protein, 10 aa, Artificial Sequence
  Synthetic peptide
  misc_feature (5)..(5): Xaa is Serine or Phosphoserine
ESDEXGESAP

SEQ ID NO: 1157 - protein, 11 aa, Artificial Sequence
  Synthetic peptide
  misc_feature (6)..(6): Xaa is Serine or Phosphoserine
RESDEXGESAP

SEQ ID NO: 1158 - protein, 5 aa, Artificial Sequence
  Synthetic peptide
  misc_feature (5)..(5): Xaa is Serine or Phosphoserine
ESGEX

SEQ ID NO: 1159 - protein, 5 aa, Artificial Sequence
  Synthetic peptide
  misc_feature (4)..(4): Xaa is Serine or Phosphoserine
SGEXA

SEQ ID NO: 1160 - protein, 5 aa, Artificial Sequence
  Synthetic peptide
  misc_feature (3)..(3): Xaa is Serine or Phosphoserine
GEXAP

SEQ ID NO: 1161 - protein, 5 aa, Artificial Sequence
  Synthetic peptide
  misc_feature (2)..(2): Xaa is Serine or Phosphoserine
EXAPD

SEQ ID NO: 1162 - protein, 5 aa, Artificial Sequence
  Synthetic peptide
  misc_feature (1)..(1): Xaa is Serine or Phosphoserine
XAPDE

SEQ ID NO: 1163 - protein, 6 aa, Artificial Sequence
  Synthetic peptide
  misc_feature (6)..(6): Xaa is Serine or Phosphoserine
DESGEX

SEQ ID NO: 1164 - protein, 6 aa, Artificial Sequence
  Synthetic peptide
  misc_feature (5)..(5): Xaa is Serine or Phosphoserine
ESGEXA

SEQ ID NO: 1165 - protein, 6 aa, Artificial Sequence
  Synthetic peptide
  misc_feature (4)..(4): Xaa is Serine or Phosphoserine
SGEXAP

SEQ ID NO: 1166 - protein, 6 aa, Artificial Sequence
  Synthetic peptide
  misc_feature (3)..(3): Xaa is Serine or Phosphoserine
GEXAPD

SEQ ID NO: 1167 - protein, 6 aa, Artificial Sequence
  Synthetic peptide
  misc_feature (2)..(2): Xaa is Serine or Phosphoserine
EXAPDE

SEQ ID NO: 1168 - protein, 6 aa, Artificial Sequence
  Synthetic peptide
  misc_feature (1)..(1): Xaa is Serine or Phosphoserine
XAPDEG

SEQ ID NO: 1169 - protein, 7 aa, Artificial Sequence
  Synthetic peptide
  misc_feature (6)..(6): Xaa is Serine or Phosphoserine
DESGEXA

SEQ ID NO: 1170 - protein, 7 aa, Artificial Sequence
  Synthetic peptide
  misc_feature (5)..(5): Xaa is Serine or Phosphoserine
ESGEXAP

SEQ ID NO: 1171 - protein, 7 aa, Artificial Sequence
  Synthetic peptide
  misc_feature (4)..(4): Xaa is Serine or Phosphoserine
SGEXAPD

SEQ ID NO: 1172 - protein, 7 aa, Artificial Sequence
  Synthetic peptide
  misc_feature (3)..(3): Xaa is Serine or Phosphoserine
GEXAPDE

SEQ ID NO: 1173 - protein, 7 aa, Artificial Sequence
  Synthetic peptide
  misc_feature (2)..(2): Xaa is Serine or Phosphoserine
EXAPDEG

SEQ ID NO: 1174 - protein, 8 aa, Artificial Sequence
  Synthetic peptide
  misc_feature (6)..(6): Xaa is Serine or Phosphoserine
DESGEXAP

SEQ ID NO: 1175 - protein, 8 aa, Artificial Sequence
  Synthetic peptide
  misc_feature (5)..(5): Xaa is Serine or Phosphoserine
ESGEXAPD

SEQ ID NO: 1176 - protein, 8 aa, Artificial Sequence
  Synthetic peptide
  misc_feature (4)..(4): Xaa is Serine or Phosphoserine
SGEXAPDE

SEQ ID NO: 1177 - protein, 8 aa, Artificial Sequence
  Synthetic peptide
  misc_feature (3)..(3): Xaa is Serine or Phosphoserine
GEXAPDEG

SEQ ID NO: 1178 - protein, 9 aa, Artificial Sequence
  Synthetic peptide
  misc_feature (6)..(6): Xaa is Serine or Phosphoserine
DESGEXAPD

SEQ ID NO: 1179 - protein, 9 aa, Artificial Sequence
  Synthetic peptide
  misc_feature (5)..(5): Xaa is Serine or Phosphoserine
ESGEXAPDE

SEQ ID NO: 1180 - protein, 9 aa, Artificial Sequence
  Synthetic peptide
  misc_feature (4)..(4): Xaa is Serine or Phosphoserine
SGEXAPDEG

SEQ ID NO: 1181 - protein, 10 aa, Artificial Sequence
  Synthetic peptide
  misc_feature (6)..(6): Xaa is Serine or Phosphoserine
DESGEXAPDE

SEQ ID NO: 1182 - protein, 10 aa, Artificial Sequence
  Synthetic peptide
  misc_feature (5)..(5): Xaa is Serine or Phosphoserine
ESGEXAPDEG

SEQ ID NO: 1183 - protein, 11 aa, Artificial Sequence
  Synthetic peptide
  misc_feature (6)..(6): Xaa is Serine or Phosphoserine
DESGEXAPDEG

SEQ ID NO: 1184 - protein, 5 aa, Artificial Sequence
  Synthetic peptide
  misc_feature (5)..(5): Xaa is Serine or Phosphoserine
PEEGX

SEQ ID NO: 1185 - protein, 5 aa, Artificial Sequence
  Synthetic peptide
  misc_feature (4)..(4): Xaa is Serine or Phosphoserine
EEGXE

SEQ ID NO: 1186 - protein, 5 aa, Artificial Sequence
  Synthetic peptide
  misc_feature (3)..(3): Xaa is Serine or Phosphoserine
EGXED

SEQ ID NO: 1187 - protein, 5 aa, Artificial Sequence
  Synthetic peptide
  misc_feature (2)..(2): Xaa is Serine or Phosphoserine
GXEDE

SEQ ID NO: 1188 - protein, 5 aa, Artificial Sequence
  Synthetic peptide
  misc_feature (1)..(1): Xaa is Serine or Phosphoserine
XEDEL

SEQ ID NO: 1189 - protein, 6 aa, Artificial Sequence
  Synthetic peptide
  misc_feature (6)..(6): Xaa is Serine or Phosphoserine
VPEEGX

SEQ ID NO: 1190 - protein, 6 aa, Artificial Sequence
  Synthetic peptide
  misc_feature (5)..(5): Xaa is Serine or Phosphoserine
PEEGXE

SEQ ID NO: 1191 - protein, 6 aa, Artificial Sequence
  Synthetic peptide
  misc_feature (4)..(4): Xaa is Serine or Phosphoserine
EEGXED

SEQ ID NO: 1192 - protein, 6 aa, Artificial Sequence
  Synthetic peptide
  misc_feature (3)..(3): Xaa is Serine or Phosphoserine
EGXEDE

SEQ ID NO: 1193 - protein, 6 aa, Artificial Sequence
  Synthetic peptide
  misc_feature (2)..(2): Xaa is Serine or Phosphoserine
GXEDEL

SEQ ID NO: 1194 - protein, 6 aa, Artificial Sequence
  Synthetic peptide
  misc_feature (1)..(1): Xaa is Serine or Phosphoserine
XEDELP

SEQ ID NO: 1195 - protein, 7 aa, Artificial Sequence
  Synthetic peptide
  misc_feature (6)..(6): Xaa is Serine or Phosphoserine
VPEEGXE

SEQ ID NO: 1196 - protein, 7 aa, Artificial Sequence
  Synthetic peptide
  misc_feature (5)..(5): Xaa is Serine or Phosphoserine
PEEGXED

SEQ ID NO: 1197 - protein, 7 aa, Artificial Sequence
  Synthetic peptide
  misc_feature (4)..(4): Xaa is Serine or Phosphoserine
EEGXEDE

SEQ ID NO: 1198 - protein, 7 aa, Artificial Sequence
  Synthetic peptide
  misc_feature (3)..(3): Xaa is Serine or Phosphoserine
EGXEDEL

SEQ ID NO: 1199 - protein, 7 aa, Artificial Sequence
  Synthetic peptide
  misc_feature (2)..(2): Xaa is Serine or Phosphoserine
GXEDELP

SEQ ID NO: 1200 - protein, 8 aa, Artificial Sequence
  Synthetic peptide
  misc_feature (6)..(6): Xaa is Serine or Phosphoserine
VPEEGXED

SEQ ID NO: 1201 - protein, 8 aa, Artificial Sequence
  Synthetic peptide
  misc_feature (5)..(5): Xaa is Serine or Phosphoserine
PEEGXEDE

SEQ ID NO: 1202 - protein, 8 aa, Artificial Sequence
  Synthetic peptide
  misc_feature (4)..(4): Xaa is Serine or Phosphoserine
EEGXEDEL

SEQ ID NO: 1203 - protein, 8 aa, Artificial Sequence
  Synthetic peptide
  misc_feature (3)..(3): Xaa is Serine or Phosphoserine
EGXEDELP

SEQ ID NO: 1204 - protein, 9 aa, Artificial Sequence
  Synthetic peptide
  misc_feature (6)..(6): Xaa is Serine or Phosphoserine
VPEEGXEDE

SEQ ID NO: 1205 - protein, 9 aa, Artificial Sequence
  Synthetic peptide
  misc_feature (5)..(5): Xaa is Serine or Phosphoserine
PEEGXEDEL

SEQ ID NO: 1206 - protein, 9 aa, Artificial Sequence
  Synthetic peptide
  misc_feature (4)..(4): Xaa is Serine or Phosphoserine
EEGXEDELP

SEQ ID NO: 1207 - protein, 10 aa, Artificial Sequence
  Synthetic peptide
  misc_feature (6)..(6): Xaa is Serine or Phosphoserine
VPEEGXEDEL

SEQ ID NO: 1208 - protein, 10 aa, Artificial Sequence
  Synthetic peptide
  misc_feature (5)..(5): Xaa is Serine or Phosphoserine
PEEGXEDELP

SEQ ID NO: 1209 - protein, 11 aa, Artificial Sequence
  Synthetic peptide
  misc_feature (6)..(6): Xaa is Serine or Phosphoserine
VPEEGXEDELP

SEQ ID NO: 1210 - protein, 5 aa, Artificial Sequence
  Synthetic peptide
  misc_feature (5)..(5): Xaa is Serine or Phosphoserine
YFRAX

SEQ ID NO: 1211 - protein, 5 aa, Artificial Sequence
  Synthetic peptide
  misc_feature (4)..(4): Xaa is Serine or Phosphoserine
FRAXF

SEQ ID NO: 1212 - protein, 5 aa, Artificial Sequence
  Synthetic peptide
  misc_feature (3)..(3): Xaa is Serine or Phosphoserine
RAXFL

SEQ ID NO: 1213 - protein, 5 aa, Artificial Sequence
  Synthetic peptide
  misc_feature (2)..(2): Xaa is Serine or Phosphoserine
AXFLD

SEQ ID NO: 1214 - protein, 5 aa, Artificial Sequence
  Synthetic peptide
  misc_feature (1)..(1): Xaa is Serine or Phosphoserine
XFLDG

SEQ ID NO: 1215 - protein, 6 aa, Artificial Sequence
  Synthetic peptide
  misc_feature (6)..(6): Xaa is Serine or Phosphoserine
LYFRAX

SEQ ID NO: 1216 - protein, 6 aa, Artificial Sequence
  Synthetic peptide
  misc_feature (5)..(5): Xaa is Serine or Phosphoserine
YFRAXF

SEQ ID NO: 1217 - protein, 6 aa, Artificial Sequence
  Synthetic peptide
  misc_feature (4)..(4): Xaa is Serine or Phosphoserine
FRAXFL

SEQ ID NO: 1218 - protein, 6 aa, Artificial Sequence
  Synthetic peptide
  misc_feature (3)..(3): Xaa is Serine or Phosphoserine
RAXFLD

SEQ ID NO: 1219 - protein, 6 aa, Artificial Sequence
  Synthetic peptide
  misc_feature (2)..(2): Xaa is Serine or Phosphoserine
AXFLDG

SEQ ID NO: 1220 - protein, 6 aa, Artificial Sequence
  Synthetic peptide
  misc_feature (1)..(1): Xaa is Serine or Phosphoserine
XFLDGR

SEQ ID NO: 1221 - protein, 7 aa, Artificial Sequence
  Synthetic peptide
  misc_feature (6)..(6): Xaa is Serine or Phosphoserine
LYFRAXF

SEQ ID NO: 1222 - protein, 7 aa, Artificial Sequence
  Synthetic peptide
  misc_feature (5)..(5): Xaa is Serine or Phosphoserine
YFRAXFL

SEQ ID NO: 1223 - protein, 7 aa, Artificial Sequence
  Synthetic peptide
  misc_feature (4)..(4): Xaa is Serine or Phosphoserine
FRAXFLD

SEQ ID NO: 1224 - protein, 7 aa, Artificial Sequence
  Synthetic peptide
  misc_feature (3)..(3): Xaa is Serine or Phosphoserine
RAXFLDG

SEQ ID NO: 1225 - protein, 7 aa, Artificial Sequence
  Synthetic peptide
  misc_feature (2)..(2): Xaa is Serine or Phosphoserine
AXFLDGR

SEQ ID NO: 1226 - protein, 8 aa, Artificial Sequence
  Synthetic peptide
  misc_feature (6)..(6): Xaa is Serine or Phosphoserine
LYFRAXFL

SEQ ID NO: 1227 - protein, 8 aa, Artificial Sequence
  Synthetic peptide
  misc_feature (5)..(5): Xaa is Serine or Phosphoserine
YFRAXFLD

SEQ ID NO: 1228 - protein, 8 aa, Artificial Sequence
  Synthetic peptide
  misc_feature (4)..(4): Xaa is Serine or Phosphoserine
FRAXFLDG

SEQ ID NO: 1229 - protein, 8 aa, Artificial Sequence
  Synthetic peptide
  misc_feature (3)..(3): Xaa is Serine or Phosphoserine
RAXFLDGR

SEQ ID NO: 1230 - protein, 9 aa, Artificial Sequence
  Synthetic peptide
  misc_feature (6)..(6): Xaa is Serine or Phosphoserine
LYFRAXFLD

SEQ ID NO: 1231 - protein, 9 aa, Artificial Sequence
  Synthetic peptide
  misc_feature (5)..(5): Xaa is Serine or Phosphoserine
YFRAXFLDG

SEQ ID NO: 1232 - protein, 9 aa, Artificial Sequence
  Synthetic peptide
  misc_feature (4)..(4): Xaa is Serine or Phosphoserine
FRAXFLDGR

SEQ ID NO: 1233 - protein, 10 aa, Artificial Sequence
  Synthetic peptide
  misc_feature (6)..(6): Xaa is Serine or Phosphoserine
LYFRAXFLDG

SEQ ID NO: 1234 - protein, 10 aa, Artificial Sequence
  Synthetic peptide
  misc_feature (5)..(5): Xaa is Serine or Phosphoserine
YFRAXFLDGR

SEQ ID NO: 1235 - protein, 11 aa, Artificial Sequence
  Synthetic peptide
  misc_feature (6)..(6): Xaa is Serine or Phosphoserine
LYFRAXFLDGR

SEQ ID NO: 1236 - protein, 5 aa, Artificial Sequence
  Synthetic peptide
  misc_feature (5)..(5): Xaa is Serine or Phosphoserine
LTDVX

SEQ ID NO: 1237 - protein, 5 aa, Artificial Sequence
  Synthetic peptide
  misc_feature (4)..(4): Xaa is Serine or Phosphoserine
TDVXP

SEQ ID NO: 1238 - protein, 5 aa, Artificial Sequence
  Synthetic peptide
  misc_feature (3)..(3): Xaa is Serine or Phosphoserine
DVXPE

SEQ ID NO: 1239 - protein, 5 aa, Artificial Sequence
  Synthetic peptide
  misc_feature (2)..(2): Xaa is Serine or Phosphoserine
VXPET

SEQ ID NO: 1240 - protein, 5 aa, Artificial Sequence
  Synthetic peptide
  misc_feature (1)..(1): Xaa is Serine or Phosphoserine
XPETT

SEQ ID NO: 1241 - protein, 6 aa, Artificial Sequence
  Synthetic peptide
  misc_feature (6)..(6): Xaa is Serine or Phosphoserine
GLTDVX

SEQ ID NO: 1242 - protein, 6 aa, Artificial Sequence
  Synthetic peptide
  misc_feature (5)..(5): Xaa is Serine or Phosphoserine
LTDVXP

SEQ ID NO: 1243 - protein, 6 aa, Artificial Sequence
  Synthetic peptide
  misc_feature (4)..(4): Xaa is Serine or Phosphoserine
TDVXPE

SEQ ID NO: 1244 - protein, 6 aa, Artificial Sequence
  Synthetic peptide
  misc_feature (3)..(3): Xaa is Serine or Phosphoserine
DVXPET

SEQ ID NO: 1245 - protein, 6 aa, Artificial Sequence
  Synthetic peptide
  misc_feature (2)..(2): Xaa is Serine or Phosphoserine
VXPETT

SEQ ID NO: 1246 - protein, 6 aa, Artificial Sequence
  Synthetic peptide
  misc_feature (1)..(1): Xaa is Serine or Phosphoserine
XPETTT

SEQ ID NO: 1247 - protein, 7 aa, Artificial Sequence
  Synthetic peptide
  misc_feature (6)..(6): Xaa is Serine or Phosphoserine
GLTDVXP

SEQ ID NO: 1248 - protein, 7 aa, Artificial Sequence
  Synthetic peptide
  misc_feature (5)..(5): Xaa is Serine or Phosphoserine
LTDVXPE

SEQ ID NO: 1249 - protein, 7 aa, Artificial Sequence
  Synthetic peptide
  misc_feature (4)..(4): Xaa is Serine or Phosphoserine
TDVXPET

SEQ ID NO: 1250 - protein, 7 aa, Artificial Sequence
  Synthetic peptide
  misc_feature (3)..(3): Xaa is Serine or Phosphoserine
DVXPETT

SEQ ID NO: 1251 - protein, 7 aa, Artificial Sequence
  Synthetic peptide
  misc_feature (2)..(2): Xaa is Serine or Phosphoserine
VXPETTT

SEQ ID NO: 1252 - protein, 8 aa, Artificial Sequence
  Synthetic peptide
  misc_feature (6)..(6): Xaa is Serine or Phosphoserine
GLTDVXPE

SEQ ID NO: 1253 - protein, 8 aa, Artificial Sequence
  Synthetic peptide
  misc_feature (5)..(5): Xaa is Serine or Phosphoserine
LTDVXPET

SEQ ID NO: 1254 - protein, 8 aa, Artificial Sequence
  Synthetic peptide
  misc_feature (4)..(4): Xaa is Serine or Phosphoserine
TDVXPETT

SEQ ID NO: 1255 - protein, 8 aa, Artificial Sequence
  Synthetic peptide
  misc_feature (3)..(3): Xaa is Serine or Phosphoserine
DVXPETTT

SEQ ID NO: 1256 - protein, 9 aa, Artificial Sequence
  Synthetic peptide
  misc_feature (6)..(6): Xaa is Serine or Phosphoserine
GLTDVXPET

SEQ ID NO: 1257 - protein, 9 aa, Artificial Sequence
  Synthetic peptide
  misc_feature (5)..(5): Xaa is Serine or Phosphoserine
LTDVXPETT

SEQ ID NO: 1258 - protein, 9 aa, Artificial Sequence
  Synthetic peptide
  misc_feature (4)..(4): Xaa is Serine or Phosphoserine
TDVXPETTT

SEQ ID NO: 1259 - protein, 10 aa, Artificial Sequence
  Synthetic peptide
  misc_feature (6)..(6): Xaa is Serine or Phosphoserine
GLTDVXPETT

SEQ ID NO: 1260 - protein, 10 aa, Artificial Sequence
  Synthetic peptide
  misc_feature (5)..(5): Xaa is Serine or Phosphoserine
LTDVXPETTT

SEQ ID NO: 1261 - protein, 11 aa, Artificial Sequence
  Synthetic peptide
  misc_feature (6)..(6): Xaa is Serine or Phosphoserine
GLTDVXPETTT

SEQ ID NO: 1262 - protein, 5 aa, Artificial Sequence
  Synthetic peptide
  misc_feature (5)..(5): Xaa is Serine or Phosphoserine
SAAVX

SEQ ID NO: 1263 - protein, 5 aa, Artificial Sequence
  Synthetic peptide
  misc_feature (4)..(4): Xaa is Serine or Phosphoserine
AAVXP

SEQ ID NO: 1264 - protein, 5 aa, Artificial Sequence
  Synthetic peptide
  misc_feature (3)..(3): Xaa is Serine or Phosphoserine
AVXPG

SEQ ID NO: 1265 - protein, 5 aa, Artificial Sequence
  Synthetic peptide
  misc_feature (2)..(2): Xaa is Serine or Phosphoserine
VXPGT

SEQ ID NO: 1266 - protein, 5 aa, Artificial Sequence
  Synthetic peptide
  misc_feature (1)..(1): Xaa is Serine or Phosphoserine
XPGTE

SEQ ID NO: 1267 - protein, 6 aa, Artificial Sequence
  Synthetic peptide
  misc_feature (6)..(6): Xaa is Serine or Phosphoserine
SSAAVX

SEQ ID NO: 1268 - protein, 6 aa, Artificial Sequence
  Synthetic peptide
  misc_feature (5)..(5): Xaa is Serine or Phosphoserine
SAAVXP

SEQ ID NO: 1269 - protein, 6 aa, Artificial Sequence
  Synthetic peptide
  misc_feature (4)..(4): Xaa is Serine or Phosphoserine
AAVXPG

SEQ ID NO: 1270 - protein, 6 aa, Artificial Sequence
  Synthetic peptide
  misc_feature (3)..(3): Xaa is Serine or Phosphoserine
AVXPGT

SEQ ID NO: 1271 - protein, 6 aa, Artificial Sequence
  Synthetic peptide
  misc_feature (2)..(2): Xaa is Serine or Phosphoserine
VXPGTE

SEQ ID NO: 1272 - protein, 6 aa, Artificial Sequence
  Synthetic peptide
  misc_feature (1)..(1): Xaa is Serine or Phosphoserine
XPGTEE

SEQ ID NO: 1273 - protein, 7 aa, Artificial Sequence
  Synthetic peptide
  misc_feature (6)..(6): Xaa is Serine or Phosphoserine
SSAAVXP

SEQ ID NO: 1274 - protein, 7 aa, Artificial Sequence
  Synthetic peptide
  misc_feature (5)..(5): Xaa is Serine or Phosphoserine
SAAVXPG

SEQ ID NO: 1275 - protein, 7 aa, Artificial Sequence
  Synthetic peptide
  misc_feature (4)..(4): Xaa is Serine or Phosphoserine
AAVXPGT

SEQ ID NO: 1276 - protein, 7 aa, Artificial Sequence
  Synthetic peptide
  misc_feature (3)..(3): Xaa is Serine or Phosphoserine
AVXPGTE

SEQ ID NO: 1277 - protein, 7 aa, Artificial Sequence
  Synthetic peptide
  misc_feature (2)..(2): Xaa is Serine or Phosphoserine
VXPGTEE

SEQ ID NO: 1278 - protein, 8 aa, Artificial Sequence
  Synthetic peptide
  misc_feature (6)..(6): Xaa is Serine or Phosphoserine
SSAAVXPG

SEQ ID NO: 1279 - protein, 8 aa, Artificial Sequence
  Synthetic peptide
  misc_feature (5)..(5): Xaa is Serine or Phosphoserine
SAAVXPGT

SEQ ID NO: 1280 - protein, 8 aa, Artificial Sequence
  Synthetic peptide
  misc_feature (4)..(4): Xaa is Serine or Phosphoserine
AAVXPGTE

SEQ ID NO: 1281 - protein, 8 aa, Artificial Sequence
  Synthetic peptide
  misc_feature (3)..(3): Xaa is Serine or Phosphoserine
AVXPGTEE

SEQ ID NO: 1282 - protein, 9 aa, Artificial Sequence
  Synthetic peptide
  misc_feature (6)..(6): Xaa is Serine or Phosphoserine
SSAAVXPGT

SEQ ID NO: 1283 - protein, 9 aa, Artificial Sequence
  Synthetic peptide
  misc_feature (5)..(5): Xaa is Serine or Phosphoserine
SAAVXPGTE

SEQ ID NO: 1284 - protein, 9 aa, Artificial Sequence
  Synthetic peptide
  misc_feature (4)..(4): Xaa is Serine or Phosphoserine
AAVXPGTEE

SEQ ID NO: 1285 - protein, 10 aa, Artificial Sequence
  Synthetic peptide
  misc_feature (6)..(6): Xaa is Serine or Phosphoserine
SSAAVXPGTE

SEQ ID NO: 1286 - protein, 10 aa, Artificial Sequence
  Synthetic peptide
  misc_feature (5)..(5): Xaa is Serine or Phosphoserine
SAAVXPGTEE

SEQ ID NO: 1287 - protein, 11 aa, Artificial Sequence
  Synthetic peptide
  misc_feature (6)..(6): Xaa is Serine or Phosphoserine
SSAAVXPGTEE

SEQ ID NO: 1288 - protein, 5 aa, Artificial Sequence
  Synthetic peptide
  misc_feature (5)..(5): Xaa is Serine or Phosphoserine
NEKDX

SEQ ID NO: 1289 - protein, 5 aa, Artificial Sequence
  Synthetic peptide
  misc_feature (4)..(4): Xaa is Serine or Phosphoserine
EKDXR

SEQ ID NO: 1290 - protein, 5 aa, Artificial Sequence
  Synthetic peptide
  misc_feature (3)..(3): Xaa is Serine or Phosphoserine
KDXRR

SEQ ID NO: 1291 - protein, 5 aa, Artificial Sequence
  Synthetic peptide
  misc_feature (2)..(2): Xaa is Serine or Phosphoserine
DXRRR

SEQ ID NO: 1292 - protein, 5 aa, Artificial Sequence
  Synthetic peptide
  misc_feature (1)..(1): Xaa is Serine or Phosphoserine
XRRRQ

SEQ ID NO: 1293 - protein, 6 aa, Artificial Sequence
  Synthetic peptide
  misc_feature (6)..(6): Xaa is Serine or Phosphoserine
ENEKDX

SEQ ID NO: 1294 - protein, 6 aa, Artificial Sequence
  Synthetic peptide
  misc_feature (5)..(5): Xaa is Serine or Phosphoserine
NEKDXR

SEQ ID NO: 1295 - protein, 6 aa, Artificial Sequence
  Synthetic peptide
  misc_feature (4)..(4): Xaa is Serine or Phosphoserine
EKDXRR

SEQ ID NO: 1296 - protein, 6 aa, Artificial Sequence
  Synthetic peptide
  misc_feature (3)..(3): Xaa is Serine or Phosphoserine
KDXRRR

SEQ ID NO: 1297 - protein, 6 aa, Artificial Sequence
  Synthetic peptide
  misc_feature (2)..(2): Xaa is Serine or Phosphoserine
DXRRRQ

SEQ ID NO: 1298 - protein, 6 aa, Artificial Sequence
  Synthetic peptide
  misc_feature (1)..(1): Xaa is Serine or Phosphoserine
XRRRQA

SEQ ID NO: 1299 - protein, 7 aa, Artificial Sequence
  Synthetic peptide
  misc_feature (7)..(7): Xaa is Serine or Phosphoserine
CENEKDX

SEQ ID NO: 1300 - protein, 7 aa, Artificial Sequence
  Synthetic peptide
  misc_feature (6)..(6): Xaa is Serine or Phosphoserine
ENEKDXR

SEQ ID NO: 1301 - protein, 7 aa, Artificial Sequence
  Synthetic peptide
  misc_feature (5)..(5): Xaa is Serine or Phosphoserine
NEKDXRR

SEQ ID NO: 1302 - protein, 7 aa, Artificial Sequence
  Synthetic peptide
  misc_feature (4)..(4): Xaa is Serine or Phosphoserine
EKDXRRR

SEQ ID NO: 1303 - protein, 7 aa, Artificial Sequence
  Synthetic peptide
  misc_feature (3)..(3): Xaa is Serine or Phosphoserine
KDXRRRQ

SEQ ID NO: 1304 - protein, 7 aa, Artificial Sequence
  Synthetic peptide
  misc_feature (2)..(2): Xaa is Serine or Phosphoserine
DXRRRQA

SEQ ID NO: 1305 - protein, 8 aa, Artificial Sequence
  Synthetic peptide
  misc_feature (7)..(7): Xaa is Serine or Phosphoserine
CENEKDXR

SEQ ID NO: 1306 - protein, 8 aa, Artificial Sequence
  Synthetic peptide
  misc_feature (6)..(6): Xaa is Serine or Phosphoserine
ENEKDXRR

SEQ ID NO: 1307 - protein, 8 aa, Artificial Sequence
  Synthetic peptide
  misc_feature (5)..(5): Xaa is Serine or Phosphoserine
NEKDXRRR

SEQ ID NO: 1308 - protein, 8 aa, Artificial Sequence
  Synthetic peptide
  misc_feature (4)..(4): Xaa is Serine or Phosphoserine
EKDXRRRQ

SEQ ID NO: 1309 - protein, 7 aa, Artificial Sequence
  Synthetic peptide
  misc_feature (3)..(3): Xaa is Serine or Phosphoserine
KDXRRQA

SEQ ID NO: 1310 - protein, 9 aa, Artificial Sequence
  Synthetic peptide
  misc_feature (7)..(7): Xaa is Serine or Phosphoserine
CENEKDXRR

SEQ ID NO: 1311 - protein, 9 aa, Artificial Sequence
  Synthetic peptide
  misc_feature (6)..(6): Xaa is Serine or Phosphoserine
ENEKDXRRR

SEQ ID NO: 1312 - protein, 9 aa, Artificial Sequence
  Synthetic peptide
  misc_feature (5)..(5): Xaa is Serine or Phosphoserine
NEKDXRRRQ

SEQ ID NO: 1313 - protein, 9 aa, Artificial Sequence
  Synthetic peptide
  misc_feature (4)..(4): Xaa is Serine or Phosphoserine
EKDXRRRQA

SEQ ID NO: 1314 - protein, 10 aa, Artificial Sequence
  Synthetic peptide
  misc_feature (7)..(7): Xaa is Serine or Phosphoserine
CENEKDXRRR

SEQ ID NO: 1315 - protein, 10 aa, Artificial Sequence
  Synthetic peptide
  misc_feature (6)..(6): Xaa is Serine or Phosphoserine
ENEKDXRRRQ

SEQ ID NO: 1316 - protein, 10 aa, Artificial Sequence
  Synthetic peptide
  misc_feature (5)..(5): Xaa is Serine or Phosphoserine
NEKDXRRRQA

SEQ ID NO: 1317 - protein, 10 aa, Artificial Sequence
  Synthetic peptide
  misc_feature (7)..(7): Xaa is Serine or Phosphoserine
CENEKDXRRR

SEQ ID NO: 1318 - protein, 10 aa, Artificial Sequence
  Synthetic peptide
  misc_feature (6)..(6): Xaa is Serine or Phosphoserine
ENEKDXRRRQ

SEQ ID NO: 1319 - protein, 10 aa, Artificial Sequence
  Synthetic peptide
  misc_feature (5)..(5): Xaa is Serine or Phosphoserine
NEKDXRRRQA

SEQ ID NO: 1320 - protein, 11 aa, Artificial Sequence
  Synthetic peptide
  misc_feature (7)..(7): Xaa is Serine or Phosphoserine
CENEKDXRRRQ

SEQ ID NO: 1321 - protein, 11 aa, Artificial Sequence
  Synthetic peptide
  misc_feature (6)..(6): Xaa is Serine or Phosphoserine
ENEKDXRRRQA

SEQ ID NO: 1322 - protein, 12 aa, Artificial Sequence
  Synthetic peptide
  misc_feature (7)..(7): Xaa is Serine or Phosphoserine
CENEKDXRRRQA

SEQ ID NO: 1323 - protein, 5 aa, Artificial Sequence
  Synthetic peptide
  misc_feature (5)..(5): Xaa is Serine or Phosphoserine
FGRRX

SEQ ID NO: 1324 - protein, 5 aa, Artificial Sequence
  Synthetic peptide
  misc_feature (4)..(4): Xaa is Serine or Phosphoserine
GRRXV

SEQ ID NO: 1325 - protein, 5 aa, Artificial Sequence
  Synthetic peptide
  misc_feature (3)..(3): Xaa is Serine or Phosphoserine
RRXVS

SEQ ID NO: 1326 - protein, 5 aa, Artificial Sequence
  Synthetic peptide
  misc_feature (2)..(2): Xaa is Serine or Phosphoserine
RXVSS

SEQ ID NO: 1327 - protein, 5 aa, Artificial Sequence
  Synthetic peptide
  misc_feature (1)..(1): Xaa is Serine or Phosphoserine
XVSSF

SEQ ID NO: 1328 - protein, 6 aa, Artificial Sequence
  Synthetic peptide
  misc_feature (6)..(6): Xaa is Serine or Phosphoserine
IFGRRX

SEQ ID NO: 1329 - protein, 6 aa, Artificial Sequence
  Synthetic peptide
  misc_feature (5)..(5): Xaa is Serine or Phosphoserine
FGRRXV

SEQ ID NO: 1330 - protein, 6 aa, Artificial Sequence
  Synthetic peptide
  misc_feature (4)..(4): Xaa is Serine or Phosphoserine
GRRXVS

SEQ ID NO: 1331 - protein, 6 aa, Artificial Sequence
  Synthetic peptide
  misc_feature (3)..(3): Xaa is Serine or Phosphoserine
RRXVSS

SEQ ID NO: 1332 - protein, 6 aa, Artificial Sequence
  Synthetic peptide
  misc_feature (2)..(2): Xaa is Serine or Phosphoserine
RXVSSF

SEQ ID NO: 1333 - protein, 6 aa, Artificial Sequence
  Synthetic peptide
  misc_feature (1)..(1): Xaa is Serine or Phosphoserine
XVSSFP

SEQ ID NO: 1334 - protein, 7 aa, Artificial Sequence
  Synthetic peptide
  misc_feature (6)..(6): Xaa is Serine or Phosphoserine
IFGRRXV

SEQ ID NO: 1335 - protein, 7 aa, Artificial Sequence
  Synthetic peptide
  misc_feature (5)..(5): Xaa is Serine or Phosphoserine
FGRRXVS

SEQ ID NO: 1336 - protein, 7 aa, Artificial Sequence
  Synthetic peptide
  misc_feature (4)..(4): Xaa is Serine or Phosphoserine
GRRXVSS

SEQ ID NO: 1337 - protein, 7 aa, Artificial Sequence
  Synthetic peptide
  misc_feature (3)..(3): Xaa is Serine or Phosphoserine
RRXVSSF

SEQ ID NO: 1338 - protein, 7 aa, Artificial Sequence
  Synthetic peptide
  misc_feature (2)..(2): Xaa is Serine or Phosphoserine
RXVSSFP

SEQ ID NO: 1339 - protein, 8 aa, Artificial Sequence
  Synthetic peptide
  misc_feature (6)..(6): Xaa is Serine or Phosphoserine
IFGRRXVS

SEQ ID NO: 1340 - protein, 8 aa, Artificial Sequence
  Synthetic peptide
  misc_feature (5)..(5): Xaa is Serine or Phosphoserine
FGRRXVSS

SEQ ID NO: 1341 - protein, 8 aa, Artificial Sequence
  Synthetic peptide
  misc_feature (4)..(4): Xaa is Serine or Phosphoserine
GRRXVSSF

SEQ ID NO: 1342 - protein, 8 aa, Artificial Sequence
  Synthetic peptide
  misc_feature (3)..(3): Xaa is Serine or Phosphoserine
RRXVSSFP

SEQ ID NO: 1343 - protein, 9 aa, Artificial Sequence
  Synthetic peptide
  misc_feature (6)..(6): Xaa is Serine or Phosphoserine
IFGRRXVSS

SEQ ID NO: 1344 - protein, 9 aa, Artificial Sequence
  Synthetic peptide
  misc_feature (5)..(5): Xaa is Serine or Phosphoserine
FGRRXVSSF

SEQ ID NO: 1345 - protein, 9 aa, Artificial Sequence
  Synthetic peptide
  misc_feature (4)..(4): Xaa is Serine or Phosphoserine
GRRXVSSFP

SEQ ID NO: 1346 - protein, 10 aa, Artificial Sequence
  Synthetic peptide
  misc_feature (6)..(6): Xaa is Serine or Phosphoserine
IFGRRXVSSF

SEQ ID NO: 1347 - protein, 10 aa, Artificial Sequence
  Synthetic peptide
  misc_feature (5)..(5): Xaa is Serine or Phosphoserine
FGRRXVSSFP

SEQ ID NO: 1348 - protein, 11 aa, Artificial Sequence
  Synthetic peptide
  misc_feature (6)..(6): Xaa is Serine or Phosphoserine
IFGRRXVSSFP

SEQ ID NO: 1349 - protein, 5 aa, Artificial Sequence
  Synthetic peptide
  misc_feature (5)..(5): Xaa is Serine or Phosphoserine
THPGX

SEQ ID NO: 1350 - protein, 5 aa, Artificial Sequence
  Synthetic peptide
  misc_feature (4)..(4): Xaa is Serine or Phosphoserine
HPGXG

SEQ ID NO: 1351 - protein, 5 aa, Artificial Sequence
  Synthetic peptide
  misc_feature (3)..(3): Xaa is Serine or Phosphoserine
PGXGK

SEQ ID NO: 1352 - protein, 5 aa, Artificial Sequence
  Synthetic peptide
  misc_feature (2)..(2): Xaa is Serine or Phosphoserine
GXGKE

SEQ ID NO: 1353 - protein, 5 aa, Artificial Sequence
  Synthetic peptide
  misc_feature (1)..(1): Xaa is Serine or Phosphoserine
XGKEV

SEQ ID NO: 1354 - protein, 6 aa, Artificial Sequence
  Synthetic peptide
  misc_feature (6)..(6): Xaa is Serine or Phosphoserine
DTHPGX

SEQ ID NO: 1355 - protein, 6 aa, Artificial Sequence
  Synthetic peptide
  misc_feature (5)..(5): Xaa is Serine or Phosphoserine
THPGXG

SEQ ID NO: 1356 - protein, 6 aa, Artificial Sequence
  Synthetic peptide
  misc_feature (4)..(4): Xaa is Serine or Phosphoserine
HPGXGK

SEQ ID NO: 1357 - protein, 6 aa, Artificial Sequence
  Synthetic peptide
  misc_feature (3)..(3): Xaa is Serine or Phosphoserine
PGXGKE

SEQ ID NO: 1358 - protein, 6 aa, Artificial Sequence
  Synthetic peptide
  misc_feature (2)..(2): Xaa is Serine or Phosphoserine
GXGKEV

SEQ ID NO: 1359 - protein, 6 aa, Artificial Sequence
  Synthetic peptide
  misc_feature (1)..(1): Xaa is Serine or Phosphoserine
XGKEVR

SEQ ID NO: 1360 - protein, 7 aa, Artificial Sequence
  Synthetic peptide
  misc_feature (6)..(6): Xaa is Serine or Phosphoserine
DTHPGXG

SEQ ID NO: 1361 - protein, 7 aa, Artificial Sequence
  Synthetic peptide
  misc_feature (5)..(5): Xaa is Serine or Phosphoserine
THPGXGK

SEQ ID NO: 1362 - protein, 7 aa, Artificial Sequence
  Synthetic peptide
  misc_feature (4)..(4): Xaa is Serine or Phosphoserine
HPGXGKE

SEQ ID NO: 1363 - protein, 7 aa, Artificial Sequence
  Synthetic peptide
  misc_feature (3)..(3): Xaa is Serine or Phosphoserine
PGXGKEV

SEQ ID NO: 1364 - protein, 7 aa, Artificial Sequence
  Synthetic peptide
  misc_feature (2)..(2): Xaa is Serine or Phosphoserine
GXGKEVR

SEQ ID NO: 1365 - protein, 8 aa, Artificial Sequence
  Synthetic peptide
  misc_feature (6)..(6): Xaa is Serine or Phosphoserine
DTHPGXGK

SEQ ID NO: 1366 - protein, 8 aa, Artificial Sequence
  Synthetic peptide
  misc_feature (5)..(5): Xaa is Serine or Phosphoserine
THPGXGKE

SEQ ID NO: 1367 - protein, 8 aa, Artificial Sequence
  Synthetic peptide
  misc_feature (4)..(4): Xaa is Serine or Phosphoserine
HPGXGKEV

SEQ ID NO: 1368 - protein, 8 aa, Artificial Sequence
  Synthetic peptide
  misc_feature (3)..(3): Xaa is Serine or Phosphoserine
PGXGKEVR

SEQ ID NO: 1369 - protein, 9 aa, Artificial Sequence
  Synthetic peptide
  misc_feature (6)..(6): Xaa is Serine or Phosphoserine
DTHPGXGKE

SEQ ID NO: 1370 - protein, 9 aa, Artificial Sequence
  Synthetic peptide
  misc_feature (5)..(5): Xaa is Serine or Phosphoserine
THPGXGKEV

SEQ ID NO: 1371 - protein, 9 aa, Artificial Sequence
  Synthetic peptide
  misc_feature (4)..(4): Xaa is Serine or Phosphoserine
HPGXGKEVR

SEQ ID NO: 1372 - protein, 10 aa, Artificial Sequence
  Synthetic peptide
  misc_feature (6)..(6): Xaa is Serine or Phosphoserine
DTHPGXGKEV

SEQ ID NO: 1373 - protein, 10 aa, Artificial Sequence
  Synthetic peptide
  misc_feature (5)..(5): Xaa is Serine or Phosphoserine
THPGXGKEVR

SEQ ID NO: 1374 - protein, 11 aa, Artificial Sequence
  Synthetic peptide
  misc_feature (6)..(6): Xaa is Serine or Phosphoserine
DTHPGXGKEVR

SEQ ID NO: 1375 - protein, 5 aa, Artificial Sequence
  Synthetic peptide
  misc_feature (5)..(5): Xaa is Serine or Phosphoserine
EETNX

SEQ ID NO: 1376 - protein, 5 aa, Artificial Sequence
  Synthetic peptide
  misc_feature (4)..(4): Xaa is Serine or Phosphoserine
ETNXG

SEQ ID NO: 1377 - protein, 5 aa, Artificial Sequence
  Synthetic peptide
  misc_feature (3)..(3): Xaa is Serine or Phosphoserine
TNXGE

SEQ ID NO: 1378 - protein, 5 aa, Artificial Sequence
  Synthetic peptide
  misc_feature (2)..(2): Xaa is Serine or Phosphoserine
NXGEE

SEQ ID NO: 1379 - protein, 5 aa, Artificial Sequence
  Synthetic peptide
  misc_feature (1)..(1): Xaa is Serine or Phosphoserine
XGEEP

SEQ ID NO: 1380 - protein, 6 aa, Artificial Sequence
  Synthetic peptide
  misc_feature (6)..(6): Xaa is Serine or Phosphoserine
EEETNX

SEQ ID NO: 1381 - protein, 6 aa, Artificial Sequence
  Synthetic peptide
  misc_feature (5)..(5): Xaa is Serine or Phosphoserine
EETNXG

SEQ ID NO: 1382 - protein, 6 aa, Artificial Sequence
  Synthetic peptide
  misc_feature (4)..(4): Xaa is Serine or Phosphoserine
ETNXGE

SEQ ID NO: 1383 - protein, 6 aa, Artificial Sequence
  Synthetic peptide
  misc_feature (3)..(3): Xaa is Serine or Phosphoserine
TNXGEE

SEQ ID NO: 1384 - protein, 6 aa, Artificial Sequence
  Synthetic peptide
  misc_feature (2)..(2): Xaa is Serine or Phosphoserine
NXGEEP

SEQ ID NO: 1385 - protein, 6 aa, Artificial Sequence
  Synthetic peptide
  misc_feature (1)..(1): Xaa is Serine or Phosphoserine
XGEEPF

SEQ ID NO: 1386 - protein, 7 aa, Artificial Sequence
  Synthetic peptide
  misc_feature (6)..(6): Xaa is Serine or Phosphoserine
EEETNXG

SEQ ID NO: 1387 - protein, 7 aa, Artificial Sequence
  Synthetic peptide
  misc_feature (5)..(5): Xaa is Serine or Phosphoserine
EETNXGE

SEQ ID NO: 1388 - protein, 7 aa, Artificial Sequence
  Synthetic peptide
  misc_feature (4)..(4): Xaa is Serine or Phosphoserine
ETNXGEE

SEQ ID NO: 1389 - protein, 7 aa, Artificial Sequence
  Synthetic peptide
  misc_feature (3)..(3): Xaa is Serine or Phosphoserine
TNXGEEP

SEQ ID NO: 1390 - protein, 7 aa, Artificial Sequence
  Synthetic peptide
  misc_feature (2)..(2): Xaa is Serine or Phosphoserine
NXGEEPF

SEQ ID NO: 1391 - protein, 8 aa, Artificial Sequence
  Synthetic peptide
  misc_feature (6)..(6): Xaa is Serine or Phosphoserine
EEETNXGE

SEQ ID NO: 1392 - protein, 8 aa, Artificial Sequence
  Synthetic peptide
  misc_feature (5)..(5): Xaa is Serine or Phosphoserine
EETNXGEE

SEQ ID NO: 1393 - protein, 8 aa, Artificial Sequence
  Synthetic peptide
  misc_feature (4)..(4): Xaa is Serine or Phosphoserine
ETNXGEEP

SEQ ID NO: 1394 - protein, 8 aa, Artificial Sequence
  Synthetic peptide
  misc_feature (3)..(3): Xaa is Serine or Phosphoserine
TNXGEEPF

SEQ ID NO: 1395 - protein, 9 aa, Artificial Sequence
  Synthetic peptide
  misc_feature (6)..(6): Xaa is Serine or Phosphoserine
EEETNXGEE

SEQ ID NO: 1396 - protein, 9 aa, Artificial Sequence
  Synthetic peptide
  misc_feature (5)..(5): Xaa is Serine or Phosphoserine
EETNXGEEP

SEQ ID NO: 1397 - protein, 9 aa, Artificial Sequence
  Synthetic peptide
  misc_feature (4)..(4): Xaa is Serine or Phosphoserine
ETNXGEEPF

SEQ ID NO: 1398 - protein, 10 aa, Artificial Sequence
  Synthetic peptide
  misc_feature (6)..(6): Xaa is Serine or Phosphoserine
EEETNXGEEP

SEQ ID NO: 1399 - protein, 10 aa, Artificial Sequence
  Synthetic peptide
  misc_feature (5)..(5): Xaa is Serine or Phosphoserine
EETNXGEEPF

SEQ ID NO: 1400 - protein, 11 aa, Artificial Sequence
  Synthetic peptide
  misc_feature (6)..(6): Xaa is Serine or Phosphoserine
EEETNXGEEPF

SEQ ID NO: 1401 - protein, 5 aa, Artificial Sequence
  Synthetic peptide
  misc_feature (5)..(5): Xaa is Threonine or Phosphothreonine
PFIEX

SEQ ID NO: 1402 - protein, 5 aa, Artificial Sequence
  Synthetic peptide
  misc_feature (4)..(4): Xaa is Threonine or Phosphothreonine
FIEXP

SEQ ID NO: 1403 - protein, 5 aa, Artificial Sequence
  Synthetic peptide
  misc_feature (3)..(3): Xaa is Threonine or Phosphothreonine
IEXPR

SEQ ID NO: 1404 - protein, 5 aa, Artificial Sequence
  Synthetic peptide
  misc_feature (2)..(2): Xaa is Threonine or Phosphothreonine
EXPRQ

SEQ ID NO: 1405 - protein, 5 aa, Artificial Sequence
  Synthetic peptide
  misc_feature (1)..(1): Xaa is Threonine or Phosphothreonine
XPRQD

SEQ ID NO: 1406 - protein, 6 aa, Artificial Sequence
  Synthetic peptide
  misc_feature (6)..(6): Xaa is Threonine or Phosphothreonine
EPFIEX

SEQ ID NO: 1407 - protein, 6 aa, Artificial Sequence
  Synthetic peptide
  misc_feature (5)..(5): Xaa is Threonine or Phosphothreonine
PFIEXP

SEQ ID NO: 1408 - protein, 6 aa, Artificial Sequence
  Synthetic peptide
  misc_feature (4)..(4): Xaa is Threonine or Phosphothreonine
FIEXPR

SEQ ID NO: 1409 - protein, 6 aa, Artificial Sequence
  Synthetic peptide
  misc_feature (3)..(3): Xaa is Threonine or Phosphothreonine
IEXPRQ

SEQ ID NO: 1410 - protein, 6 aa, Artificial Sequence
  Synthetic peptide
  misc_feature (2)..(2): Xaa is Threonine or Phosphothreonine
EXPRQD

SEQ ID NO: 1411 - protein, 6 aa, Artificial Sequence
  Synthetic peptide
  misc_feature (1)..(1): Xaa is Threonine or Phosphothreonine
XPRQDG

SEQ ID NO: 1412 - protein, 7 aa, Artificial Sequence
  Synthetic peptide
  misc_feature (6)..(6): Xaa is Threonine or Phosphothreonine
EPFIEXP

SEQ ID NO: 1413 - protein, 7 aa, Artificial Sequence
  Synthetic peptide
  misc_feature (5)..(5): Xaa is Threonine or Phosphothreonine
PFIEXPR

SEQ ID NO: 1414 - protein, 7 aa, Artificial Sequence
  Synthetic peptide
  misc_feature (4)..(4): Xaa is Threonine or Phosphothreonine
FIEXPRQ

SEQ ID NO: 1415 - protein, 7 aa, Artificial Sequence
  Synthetic peptide
  misc_feature (3)..(3): Xaa is Threonine or Phosphothreonine
IEXPRQD

SEQ ID NO: 1416 - protein, 7 aa, Artificial Sequence
  Synthetic peptide
  misc_feature (2)..(2): Xaa is Threonine or Phosphothreonine
EXPRQDG

SEQ ID NO: 1417 - protein, 7 aa, Artificial Sequence
  Synthetic peptide
  misc_feature (1)..(1): Xaa is Threonine or Phosphothreonine
XPRQDGV

SEQ ID NO: 1418 - protein, 8 aa, Artificial Sequence
  Synthetic peptide
  misc_feature (6)..(6): Xaa is Threonine or Phosphothreonine
EPFIEXPR

SEQ ID NO: 1419 - protein, 8 aa, Artificial Sequence
  Synthetic peptide
  misc_feature (5)..(5): Xaa is Threonine or Phosphothreonine
PFIEXPRQ

SEQ ID NO: 1420 - protein, 8 aa, Artificial Sequence
  Synthetic peptide
  misc_feature (4)..(4): Xaa is Threonine or Phosphothreonine
FIEXPRQD

SEQ ID NO: 1421 - protein, 8 aa, Artificial Sequence
  Synthetic peptide
  misc_feature (3)..(3): Xaa is Threonine or Phosphothreonine
IEXPRQDG

SEQ ID NO: 1422 - protein, 8 aa, Artificial Sequence
  Synthetic peptide
  misc_feature (2)..(2): Xaa is Threonine or Phosphothreonine
EXPRQDGV

SEQ ID NO: 1423 - protein, 9 aa, Artificial Sequence
  Synthetic peptide
  misc_feature (6)..(6): Xaa is Threonine or Phosphothreonine
EPFIEXPRQ

SEQ ID NO: 1424 - protein, 9 aa, Artificial Sequence
  Synthetic peptide
  misc_feature (5)..(5): Xaa is Threonine or Phosphothreonine
PFIEXPRQD

SEQ ID NO: 1425 - protein, 9 aa, Artificial Sequence
  Synthetic peptide
  misc_feature (4)..(4): Xaa is Threonine or Phosphothreonine
FIEXPRQDG

SEQ ID NO: 1426 - protein, 9 aa, Artificial Sequence
  Synthetic peptide
  misc_feature (3)..(3): Xaa is Threonine or Phosphothreonine
IEXPRQDGV

SEQ ID NO: 1427 - protein, 10 aa, Artificial Sequence
  Synthetic peptide
  misc_feature (6)..(6): Xaa is Threonine or Phosphothreonine
EPFIEXPRQD

SEQ ID NO: 1428 - protein, 10 aa, Artificial Sequence
  Synthetic peptide
  misc_feature (5)..(5): Xaa is Threonine or Phosphothreonine
PFIEXPRQDG

SEQ ID NO: 1429 - protein, 10 aa, Artificial Sequence
  Synthetic peptide
  misc_feature (4)..(4): Xaa is Threonine or Phosphothreonine
FIEXPRQDGV

SEQ ID NO: 1430 - protein, 11 aa, Artificial Sequence
  Synthetic peptide
  misc_feature (6)..(6): Xaa is Threonine or Phosphothreonine
EPFIEXPRQDG

SEQ ID NO: 1431 - protein, 11 aa, Artificial Sequence
  Synthetic peptide
  misc_feature (5)..(5): Xaa is Threonine or Phosphothreonine
PFIEXPRQDGV

SEQ ID NO: 1432 - protein, 12 aa, Artificial Sequence
  Synthetic peptide
  misc_feature (6)..(6): Xaa is Threonine or Phosphothreonine
EPFIEXPRQDGV

SEQ ID NO: 1433 - protein, 5 aa, Artificial Sequence
  Synthetic peptide
  misc_feature (5)..(5): Xaa is Serine or Phosphoserine
DELKX

SEQ ID NO: 1434 - protein, 5 aa, Artificial Sequence
  Synthetic peptide
  misc_feature (4)..(4): Xaa is Serine or Phosphoserine
ELKXV

SEQ ID NO: 1435 - protein, 5 aa, Artificial Sequence
  Synthetic peptide
  misc_feature (3)..(3): Xaa is Serine or Phosphoserine
LKXVE

SEQ ID NO: 1436 - protein, 5 aa, Artificial Sequence
  Synthetic peptide
  misc_feature (2)..(2): Xaa is Serine or Phosphoserine
KXVEN

SEQ ID NO: 1437 - protein, 5 aa, Artificial Sequence
  Synthetic peptide
  misc_feature (1)..(1): Xaa is Serine or Phosphoserine
XVENQ

SEQ ID NO: 1438 - protein, 6 aa, Artificial Sequence
  Synthetic peptide
  misc_feature (6)..(6): Xaa is Serine or Phosphoserine
DDELKX

SEQ ID NO: 1439 - protein, 6 aa, Artificial Sequence
  Synthetic peptide
  misc_feature (5)..(5): Xaa is Serine or Phosphoserine
DELKXV

SEQ ID NO: 1440 - protein, 6 aa, Artificial Sequence
  Synthetic peptide
  misc_feature (4)..(4): Xaa is Serine or Phosphoserine
ELKXVE

SEQ ID NO: 1441 - protein, 6 aa, Artificial Sequence
  Synthetic peptide
  misc_feature (3)..(3): Xaa is Serine or Phosphoserine
LKXVEN

SEQ ID NO: 1442 - protein, 6 aa, Artificial Sequence
  Synthetic peptide
  misc_feature (2)..(2): Xaa is Serine or Phosphoserine
KXVENQ

SEQ ID NO: 1443 - protein, 6 aa, Artificial Sequence
  Synthetic peptide
  misc_feature (1)..(1): Xaa is Serine or Phosphoserine
XVENQM

SEQ ID NO: 1444 - protein, 7 aa, Artificial Sequence
  Synthetic peptide
  misc_feature (6)..(6): Xaa is Serine or Phosphoserine
DDELKXV

SEQ ID NO: 1445 - protein, 7 aa, Artificial Sequence
  Synthetic peptide
  misc_feature (5)..(5): Xaa is Serine or Phosphoserine
DELKXVE

SEQ ID NO: 1446 - protein, 7 aa, Artificial Sequence
  Synthetic peptide
  misc_feature (4)..(4): Xaa is Serine or Phosphoserine
ELKXVEN

SEQ ID NO: 1447 - protein, 7 aa, Artificial Sequence
  Synthetic peptide
  misc_feature (3)..(3): Xaa is Serine or Phosphoserine
LKXVENQ

SEQ ID NO: 1448 - protein, 7 aa, Artificial Sequence
  Synthetic peptide
  misc_feature (2)..(2): Xaa is Serine or Phosphoserine
KXVENQM

SEQ ID NO: 1449 - protein, 8 aa, Artificial Sequence
  Synthetic peptide
  misc_feature (6)..(6): Xaa is Serine or Phosphoserine
DDELKXVE

SEQ ID NO: 1450 - protein, 8 aa, Artificial Sequence
  Synthetic peptide
  misc_feature (5)..(5): Xaa is Serine or Phosphoserine
DELKXVEN

SEQ ID NO: 1451 - protein, 8 aa, Artificial Sequence
  Synthetic peptide
  misc_feature (4)..(4): Xaa is Serine or Phosphoserine
ELKXVENQ

SEQ ID NO: 1452 - protein, 8 aa, Artificial Sequence
  Synthetic peptide
  misc_feature (3)..(3): Xaa is Serine or Phosphoserine
LKXVENQM

SEQ ID NO: 1453 - protein, 9 aa, Artificial Sequence
  Synthetic peptide
  misc_feature (6)..(6): Xaa is Serine or Phosphoserine
DDELKXVEN

SEQ ID NO: 1454 - protein, 9 aa, Artificial Sequence
  Synthetic peptide
  misc_feature (5)..(5): Xaa is Serine or Phosphoserine
DELKXVENQ

SEQ ID NO: 1455 - protein, 9 aa, Artificial Sequence
  Synthetic peptide
  misc_feature (4)..(4): Xaa is Serine or Phosphoserine
ELKXVENQM

SEQ ID NO: 1456 - protein, 10 aa, Artificial Sequence
  Synthetic peptide
  misc_feature (6)..(6): Xaa is Serine or Phosphoserine
DDELKXVENQ

SEQ ID NO: 1457 - protein, 10 aa, Artificial Sequence
  Synthetic peptide
  misc_feature (5)..(5): Xaa is Serine or Phosphoserine
DELKXVENQM

SEQ ID NO: 1458 - protein, 11 aa, Artificial Sequence
  Synthetic peptide
  misc_feature (6)..(6): Xaa is Serine or Phosphoserine
DDELKXVENQM

SEQ ID NO: 1459 - protein, 11 aa, Artificial Sequence
  Synthetic peptide
  misc_feature (6)..(6): Xaa is Serine or Phosphoserine
IFGRRXVSSFP

SEQ ID NO: 1460 - protein, 11 aa, Artificial Sequence
  Synthetic peptide
  misc_feature (6)..(6): Xaa is Serine or Phosphoserine
EEETNXGEEPF

SEQ ID NO: 1461 - protein, 12 aa, Artificial Sequence
  Synthetic peptide
  misc_feature (6)..(6): Xaa is Tyrosine or Phosphotyrosine
EPFIEXPRQDGV

SEQ ID NO: 1462 - protein, 11 aa, Artificial Sequence
  Synthetic peptide
LEVAEYLTPVL

SEQ ID NO: 1463 - protein, 11 aa, Artificial Sequence
  Synthetic peptide
ADMEEYEESGL

SEQ ID NO: 1464 - protein, 11 aa, Artificial Sequence
  Synthetic peptide
MESVLSKYEDQ

SEQ ID NO: 1465 - protein, 11 aa, Artificial Sequence
  Synthetic peptide
YRRKFSPIGGT

SEQ ID NO: 1466 - protein, 11 aa, Artificial Sequence
  Synthetic peptide
LGRDWSWEKQK

SEQ ID NO: 1467 - protein, 11 aa, Artificial Sequence
  Synthetic peptide
IDRKDSYYSIH

SEQ ID NO: 1468 - protein, 11 aa, Artificial Sequence
  Synthetic peptide
PPCRMSIAELD

SEQ ID NO: 1469 - protein, 11 aa, Artificial Sequence
  Synthetic peptide
FEASLSGEREF

SEQ ID NO: 1470 - protein, 11 aa, Artificial Sequence
  Synthetic peptide
KTPTISLKETI

SEQ ID NO: 1471 - protein, 11 aa, Artificial Sequence
  Synthetic peptide
EYGKKSGKKAG

SEQ ID NO: 1472 - protein, 11 aa, Artificial Sequence
  Synthetic peptide
DFKRASEEITK

SEQ ID NO: 1473 - protein, 11 aa, Artificial Sequence
  Synthetic peptide
KMLKFSSKEKY

SEQ ID NO: 1474 - protein, 11 aa, Artificial Sequence
  Synthetic peptide
QLKRFSTEEFV

SEQ ID NO: 1475 - protein, 11 aa, Artificial Sequence
  Synthetic peptide
QYRSSSPEDAR

SEQ ID NO: 1476 - protein, 11 aa, Artificial Sequence
  Synthetic peptide
GKPRHSLYFIG

SEQ ID NO: 1477 - protein, 11 aa, Artificial Sequence
  Synthetic peptide
RAKRPSSEDFV

SEQ ID NO: 1478 - protein, 11 aa, Artificial Sequence
  Synthetic peptide
REAEPYYLLLP

SEQ ID NO: 1479 - protein, 11 aa, Artificial Sequence
  Synthetic peptide
KEVCPSAIDPE

SEQ ID NO: 1480 - protein, 11 aa, Artificial Sequence
  Synthetic peptide
TNTLESFKTAD

SEQ ID NO: 1481 - protein, 11 aa, Artificial Sequence
  Synthetic peptide
LDQRFSLKQIE

SEQ ID NO: 1482 - protein, 12 aa, Artificial Sequence
  Synthetic peptide
TFKQRRTFEQRV

SEQ ID NO: 1483 - protein, 11 aa, Artificial Sequence
  Synthetic peptide
SEVYESEKDED

SEQ ID NO: 1484 - protein, 11 aa, Artificial Sequence
  Synthetic peptide
PRDGSSLEDRP

SEQ ID NO: 1485 - protein, 11 aa, Artificial Sequence
  Synthetic peptide
PRDGBSLEDRP

SEQ ID NO: 1486 - protein, 11 aa, Artificial Sequence
  Synthetic peptide
PRDGSSLEDRP

SEQ ID NO: 1487 - protein, 11 aa, Artificial Sequence
  Synthetic peptide
QRLEASYSDSP

SEQ ID NO: 1488 - protein, 11 aa, Artificial Sequence
  Synthetic peptide
TELDIYHRILR

SEQ ID NO: 1489 - protein, 11 aa, Artificial Sequence
  Synthetic peptide
IQSLQSESEPL

SEQ ID NO: 1490 - protein, 11 aa, Artificial Sequence
  Synthetic peptide
WHRRESDESGE

SEQ ID NO: 1491 - protein, 11 aa, Artificial Sequence
  Synthetic peptide
RESDESGESAP

SEQ ID NO: 1492 - protein, 11 aa, Artificial Sequence
  Synthetic peptide
DESGESAPDEG

SEQ ID NO: 1493 - protein, 11 aa, Artificial Sequence
  Synthetic peptide
VPEEGSEDELP

SEQ ID NO: 1494 - protein, 11 aa, Artificial Sequence
  Synthetic peptide
LYFRASFLDGR

SEQ ID NO: 1495 - protein, 11 aa, Artificial Sequence
  Synthetic peptide
GLTDVSPETTT

SEQ ID NO: 1496 - protein, 11 aa, Artificial Sequence
  Synthetic peptide
SSAAVSPGTEE

SEQ ID NO: 1497 - protein, 11 aa, Artificial Sequence
  Synthetic peptide
IFGRRSVSSFP

SEQ ID NO: 1498 - protein, 11 aa, Artificial Sequence
  Synthetic peptide
DTHPGSGKEVR

SEQ ID NO: 1499 - protein, 11 aa, Artificial Sequence
  Synthetic peptide
EEETNSGEEPF

SEQ ID NO: 1500 - protein, 12 aa, Artificial Sequence
  Synthetic peptide
EPFIETPRQDGV

SEQ ID NO: 1501 - protein, 11 aa, Artificial Sequence
  Synthetic peptide
DDELKSVENQM

The invention claimed is:

1. A method for detecting an autophagy protein or fragment comprising an amino acid sequence TNXGE (SEQ ID NO:1377), wherein the x residue is phosphorylated or nonphosphorylated serine, in a sample, which method comprises:
   (a) contacting a sample containing or suspected of containing an autophagy protein or fragment comprising said amino acid sequence with an isolated antibody that specifically binds to an epitope that comprises the amino acid residue x in said amino acid sequence, wherein the x residue is phosphorylated or nonphosphorylated serine; and
   (b) assessing a complex formed between said autophagy protein or fragment, if present in said sample, and said antibody, to determine the presence, absence and/or amount of said autophagy protein or fragment in said sample.

2. The method of claim 1, wherein the isolated antibody specifically binds to the epitope that comprises the x residue in the amino acid sequence, wherein the x residue is nonphosphorylated serine.

3. The method of claim 1, wherein the isolated antibody specifically binds to the epitope that comprises the x residue in the amino acid sequence, wherein the x residue is phosphorylated serine.

4. The method of claim 1, wherein the isolated antibody specifically binds to an epitope comprised in the amino acid sequence wherein the x residue is nonphosphorylated serine, but does not specifically bind to an epitope comprised in the amino acid sequence wherein the x residue is phosphorylated serine.

5. The method of claim 1, wherein the isolated antibody specifically binds to an epitope comprised in the amino acid sequence wherein the x residue is phosphorylated serine, but does not specifically bind to an epitope comprised in the amino acid sequence wherein the x residue is nonphosphorylated serine.

6. The method of claim 1, wherein the isolated antibody specifically binds to the epitope comprising an amino acid sequence selected from the group consisting of ETNX (SEQ ID NO:180), TNXG (SEQ ID NO:181), NXGE (SEQ ID NO:182), XGEE (SEQ ID NO:183), EETNX (SEQ ID NO:1375), ETNXG (SEQ ID NO:1376), TNXGE (SEQ ID NO:1377), NXGEE (SEQ ID NO:1378), XGEEP (SEQ ID NO:1379), EEETNX (SEQ ID NO:1380), EETNXG (SEQ ID NO:1381), ETNXGE (SEQ ID NO:1382), TNXGEE (SEQ ID NO:1383), NXGEEP (SEQ ID NO:1384), XGEEPF (SEQ ID NO:1385), EEETNXG (SEQ ID NO:1386), EETNXGE (SEQ ID NO:1387), ETNXGEE (SEQ ID NO:1388), TNXGEEP (SEQ ID NO:1389), NXGEEPF (SEQ ID NO:1390), EEETNXGE (SEQ ID NO:1391), EETNXGEE (SEQ ID NO:1392), ETNXGEEP (SEQ ID NO:1393), TNXGEEPF (SEQ ID NO:1394), EEETNXGEE (SEQ ID NO:1395), EETNXGEEP (SEQ ID NO:1396), ETNXGEEPF (SEQ ID NO:1397), EEETNXGEEP (SEQ ID NO:1398), EETNXGEEPF (SEQ ID NO:1399), and EEETNXGEEPF (SEQ ID NO:1400), wherein the x residue is phosphorylated or nonphosphorylated serine.

* * * * *